United States Patent 11,141,474 (ARTIFICIAL NUCLEIC ACID MOLECULES ENCODING A NOROVIRUS ANTIGEN AND USES THEREOF) - sequence listing, part 11

SEQ ID NO: 24095 - RNA, 1647 nt, Artificial Sequence
  derived and/or modified sequence opt4 from major_capsid_protein__Norovirus__AFC89662
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaccgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagaucuucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24096 - RNA, 1620 nt, Artificial Sequence
  derived and/or modified sequence opt4 from major_capsid_protein__Norovirus__AFC89665
augaagauggccagcaacgacgccgcccccagcaacgacggcgccaccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaugaccagcaaccccaccagcgacuacugggacgaccaccugcugcaccuggugcaccccaacggcgccaccuacgaccccaccgaggacgugcccgcccccuucggcacccaggacuucagaggcauccuguacggcaugcugacccagaaccccagaaccagcggcgacgaggccgccaacagccacggcaucuacaucagcagcaccagcgagaaguucacccccaagcugggcaccaucggccugcaccaggugcagggcgacaucgccagcaaccagcagagcaaguucacccccgugggcaucgccgugaacggcaacacccccuucagacagugggagcugcccaacuacagcggcgcccugacccugaacaccaaccuggcccccgccgugggccccaacuuccccggcgagcagauccuguucuucagaagcaacgugcccagcgugcagggcggccagcccaucgagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagugcaguga

SEQ ID NO: 24097 - RNA, 1623 nt, Artificial Sequence; identical to SEQ ID NO: 22522
  derived and/or modified sequence opt4 from major_capsid_protein__Norovirus__AFC89667

SEQ ID NO: 24098 - RNA, 1626 nt, Artificial Sequence
  derived and/or modified sequence opt4 from major_capsid_protein__Norovirus__AFD62272
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggccagguggccaccuucaccaugaucgagcaggacggcagcgccuacgugcccggcgacagagccgccccccugggcuaccccgacuacagcggccagcuggagaucgaggugcagaccgagaccaccaaggccggcgacaagcugaaggugaccaccuucgagaugauccugggccccaccaccaacguggaccaggcccccuaccagggcagagccuacgccagccugaccgccgccgccagccuggaccugguggacggcagagugagagccgugcccagaagcaucuacagcuuccaggacgugcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucgugagcugguucgccagcaacagcuucaccgugcagagcgacgcccugcuggugagauacagaaacacccugaccggccagcugcuguucgaggccaagcuguacagcgagggcuacaucgccgugagcuacagcggcagcggcccccugaccuuccccgccgacggcuucuucgagguggugagcugggugcccagacuguuccagcuggccagcgugggcagccuggccaccggcagaacccugaagcaguga

SEQ ID NO: 24099 - RNA, 1620 nt, Artificial Sequence
  derived and/or modified sequence opt4 from major_capsid_protein__Norovirus__AFJ04707
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacaucacccacaucgccggcagccacgacuacaccaugaaccuggccagccagaacuggagcaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcggcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagagcccuguga

SEQ ID NO: 24100 - RNA, 1623 nt, Artificial Sequence
  derived and/or modified sequence opt4 from major_capsid_protein__Norovirus__AFJ04708
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24101 - RNA, 1623 nt, Artificial Sequence
  derived and/or modified sequence opt4 from major_capsid_protein__Norovirus__AFJ04709
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcggcagaagagcccuguga

SEQ ID NO: 24102 - RNA, 1623 nt, Artificial Sequence
  derived and/or modified sequence opt4 from major_capsid_protein__Norovirus__AFP89593
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcgugauccaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugcuguga

SEQ ID NO: 24103 - RNA, 1623 nt, Artificial Sequence
  derived and/or modified sequence opt4 from major_capsid_protein__Norovirus__AFU55686
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgaggccggccagaacaccaaguucacccccgacggcguggugcaggacggcaacggcacccaccagaacgagccccagcagugggugcugcccagcuacagcggcagaaccggccacaacgugcaccuggcccccgccaucgcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24104 - RNA, 1623 nt, Artificial Sequence
  derived and/or modified sequence opt4 from major_capsid_protein__Norovirus__AFU55689
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcgcccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24105 - RNA, 1623 nt, Artificial Sequence
  derived and/or modified sequence opt4 from major_capsid_protein__Norovirus__AFU55692
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24106 - RNA, 1623 nt, Artificial Sequence; identical to SEQ ID NO: 22535
  derived and/or modified sequence opt4 from major_capsid_protein__Norovirus__AFU55695

SEQ ID NO: 24107 - RNA, 1623 nt, Artificial Sequence
  derived and/or modified sequence opt4 from major_capsid_protein__Norovirus__AFU55698
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugggcgccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24108 - RNA, 1623 nt, Artificial Sequence; identical to SEQ ID NO: 23085
  derived and/or modified sequence opt4 from major_capsid_protein__Norovirus__AFU55701

SEQ ID NO: 24109 - RNA, 1623 nt, Artificial Sequence; identical to SEQ ID NO: 23174
  derived and/or modified sequence opt4 from major_capsid_protein__Norovirus__AFU55704

SEQ ID NO: 24110 - RNA, 1623 nt, Artificial Sequence
  derived and/or modified sequence opt4 from major_capsid_protein__Norovirus__AFU55707
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccgagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24111 - RNA, 1623 nt, Artificial Sequence; identical to SEQ ID NO: 22581
  derived and/or modified sequence opt4 from major_capsid_protein__Norovirus__AFU55710

SEQ ID NO: 24112 - RNA, 1623 nt, Artificial Sequence
  derived and/or modified sequence opt4 from major_capsid_protein__Norovirus__AFU55713
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24113 - RNA, 1623 nt, Artificial Sequence
  derived and/or modified sequence opt4 from major_capsid_protein__Norovirus__AFU55716
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccugaucaucccccccaacggcuacuucagauucgacagcugggugaaccaguucuacacccuggcccccaugggcaacggcaccggcagaagaagagcccuguga

SEQ ID NO: 24114 - RNA, 1623 nt, Artificial Sequence; identical to SEQ ID NO: 23157
  derived and/or modified sequence opt4 from major_capsid_protein__Norovirus__AFU55719

SEQ ID NO: 24115 - RNA, 1623 nt, Artificial Sequence; identical to SEQ ID NO: 22072
  derived and/or modified sequence opt4 from major_capsid_protein__Norovirus__AFU55722

SEQ ID NO: 24116 - RNA, 1623 nt, Artificial Sequence
  derived and/or modified sequence opt4 from major_capsid_protein__Norovirus__AFU55725
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24117 - RNA, 1623 nt, Artificial Sequence
  derived and/or modified sequence opt4 from major_capsid_protein__Norovirus__AFU55728
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24118 - RNA, 1623 nt, Artificial Sequence
  derived and/or modified sequence opt4 from major_capsid_protein__Norovirus__AFU55731
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggaggugcccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24119 - RNA, 1623 nt, Artificial Sequence; identical to SEQ ID NO: 22112
  derived and/or modified sequence opt4 from major_capsid_protein__Norovirus__AFU55734

SEQ ID NO: 24120 - RNA, 1623 nt, Artificial Sequence; identical to SEQ ID NO: 22112
  derived and/or modified sequence opt4 from major_capsid_protein__Norovirus__AFU55737

SEQ ID NO: 24121 - RNA, 1623 nt, Artificial Sequence
  derived and/or modified sequence opt4 from major_capsid_protein__Norovirus__AFU92659
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugauccccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagagcuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24122 - RNA, 1623 nt, Artificial Sequence
  derived and/or modified sequence opt4 from major_capsid_protein__Norovirus__AFU92660
augaagauggccagcaacgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24123 - RNA, 1623 nt, Artificial Sequence
  derived and/or modified sequence opt4 from major_capsid_protein__Norovirus__AFU92661
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccugugccacgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccacccugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24124 - RNA, 1623 nt, Artificial Sequence
  derived and/or modified sequence opt4 from major_capsid_protein__Norovirus__AFU92662
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggcacgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24125 - RNA, 1623 nt, Artificial Sequence
  derived and/or modified sequence opt4 from major_capsid_protein__Norovirus__AFU92663
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugaccaacaucgccggcagccagaccuacaccaugaaccuggccagccagaacuggaacaacuacgaccccaccgaggagauccccgccccccugggcacccccgacuucgugggcagaauccagggcgugcugacccagaccaccagaggcgacggcagcaccagaggccacaaggccaccgugagcaccggcagcgccuacuucacccccaagcugggcagcgugcaguucagcaccgacaccagcaccgacuucgagaccggccagaacaccagauucacccccgugggcguggugcaggacggcagcaccacccacaagaacgagccccagcagugggugcugcccagcuacagcggcagagacagccacaacgugcaccuggcccccgccguggcccccaccuuccccggcgagcagauccuguucuucagaagcaccaugcccggcugcagcggcuaccccaacauggaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24126 - RNA, 1623 nt, Artificial Sequence
  derived and/or modified sequence opt4 from major_capsid_protein__Norovirus__AFU92664
augaagauggccagcaacgacgccaaccccagcgacggcagcgccgcccaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24127 - RNA, 1623 nt, Artificial Sequence
  derived and/or modified sequence opt4 from major_capsid_protein__Norovirus__AFU92666
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccuggacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24128 - RNA, 1623 nt, Artificial Sequence
  derived and/or modified sequence opt4 from major_capsid_protein__Norovirus__AFU92667
augaagauggccagcaacgacgccacccccagcgacggcguggccgcccaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24129 - RNA, 1623 nt, Artificial Sequence
  derived and/or modified sequence opt4 from major_capsid_protein__Norovirus__AFU92668
augaagauggccagcaacgacgugacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24130 - RNA, 1623 nt, Artificial Sequence; identical to SEQ ID NO: 23140
  derived and/or modified sequence opt4 from major_capsid_protein__Norovirus__AFU92669

SEQ ID NO: 24131 - RNA, 1623 nt, Artificial Sequence
  derived and/or modified sequence opt4 from major_capsid_protein__Norovirus__AFU92670
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagagccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24132 - RNA, 1623 nt, Artificial Sequence
  derived and/or modified sequence opt4 from major_capsid_protein__Norovirus__AFU92671
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24133 - RNA, 1623 nt, Artificial Sequence
  derived and/or modified sequence opt4 from major_capsid_protein__Norovirus__AFU92672
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24134 - RNA, 1623 nt, Artificial Sequence
  derived and/or modified sequence opt4 from major_capsid_protein__Norovirus__AFU92673
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucgccgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24135 - RNA, 1623 nt, Artificial Sequence
  derived and/or modified sequence opt4 from major_capsid_protein__Norovirus__AFU92674
augaagauggccagcaacgacgcccaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaccaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24136 - RNA, 1623 nt, Artificial Sequence
  derived and/or modified sequence opt4 from major_capsid_protein__Norovirus__AFU92676
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagcagagacggcagcaccagaggccacaaggccaccgugagcaccggcagcgugcacuucacccccaagcugggcagagugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24137 - RNA, 1623 nt, Artificial Sequence
  derived and/or modified sequence opt4 from major_capsid_protein__Norovirus__AFU92677
augaagauggccagcaacgacgcccaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24138 - RNA, 1623 nt, Artificial Sequence
  derived and/or modified sequence opt4 from major_capsid_protein__Norovirus__AFU92678
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccaguacgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24139 - RNA, 1623 nt, Artificial Sequence
  derived and/or modified sequence opt4 from major_capsid_protein__Norovirus__AFU92679
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgaguucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24140 - RNA, 1623 nt, Artificial Sequence; identical to SEQ ID NO: 23140
  derived and/or modified sequence opt4 from major_capsid_protein__Norovirus__AFU92680

SEQ ID NO: 24141 - RNA, 1623 nt, Artificial Sequence; identical to SEQ ID NO: 22535
  derived and/or modified sequence opt4 from major_capsid_protein__Norovirus__AFU92681

SEQ ID NO: 24142 - RNA, 1623 nt, Artificial Sequence; identical to SEQ ID NO: 22535
  derived and/or modified sequence opt4 from major_capsid_protein__Norovirus__AFU92682

SEQ ID NO: 24143 - RNA, 1623 nt, Artificial Sequence; identical to SEQ ID NO: 23219
  derived and/or modified sequence opt4 from major_capsid_protein__Norovirus__AFU92684

SEQ ID NO: 24144 - RNA, 1623 nt, Artificial Sequence
  derived and/or modified sequence opt4 from major_capsid_protein__Norovirus__AFU92685
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacguggcccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24145 - RNA, 1623 nt, Artificial Sequence
  derived and/or modified sequence opt4 from major_capsid_protein__Norovirus__AFU92686
augaagauggccagcaacgacgcccaccccagcgacggcagcgccgccacccuggugcccaaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagcugcacgugcugcuggccggcaacgccuucaccgccggcaagaucaucaucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaucuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24146 - RNA, 1623 nt, Artificial Sequence
  derived and/or modified sequence opt4 from major_capsid_protein__Norovirus__AFU92687
augaagauggccagcaacgaccccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24147 - RNA, 1623 nt, Artificial Sequence
  derived and/or modified sequence opt4 from major_capsid_protein__Norovirus__AFU92688
augaagauggccagcaacgacgcccaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcccccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24148 - RNA, 1623 nt, Artificial Sequence; identical to SEQ ID NO: 22562
  derived and/or modified sequence opt4 from major_capsid_protein__Norovirus__AFU92689

SEQ ID NO: 24149 - RNA, 1623 nt, Artificial Sequence; identical to SEQ ID NO: 22562
  derived and/or modified sequence opt4 from major_capsid_protein__Norovirus__AFU92690

SEQ ID NO: 24150 - RNA, 1623 nt, Artificial Sequence; identical to SEQ ID NO: 22562
  derived and/or modified sequence opt4 from major_capsid_protein__Norovirus__AFU92691

SEQ ID NO: 24151 - RNA, 1623 nt, Artificial Sequence; identical to SEQ ID NO: 23219
  derived and/or modified sequence opt4 from major_capsid_protein__Norovirus__AFU92692

SEQ ID NO: 24152 - RNA, 1623 nt, Artificial Sequence
  derived and/or modified sequence opt4 from major_capsid_protein__Norovirus__AFU92693
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24153 - RNA, 1623 nt, Artificial Sequence; identical to SEQ ID NO: 22612
  derived and/or modified sequence opt4 from major_capsid_protein__Norovirus__AFU92694

SEQ ID NO: 24154 - RNA, 1623 nt, Artificial Sequence; identical to SEQ ID NO: 22671
  derived and/or modified sequence opt4 from major_capsid_protein__Norovirus__AFU92695

SEQ ID NO: 24155 - RNA, 1623 nt, Artificial Sequence; identical to SEQ ID NO: 23197
  derived and/or modified sequence opt4 from major_capsid_protein__Norovirus__AFU92696

SEQ ID NO: 24156 - RNA, 1623 nt, Artificial Sequence; identical to SEQ ID NO: 22671
  derived and/or modified sequence opt4 from major_capsid_protein__Norovirus__AFU92697

SEQ ID NO: 24157 - RNA, 1623 nt, Artificial Sequence; identical to SEQ ID NO: 22522
  derived and/or modified sequence opt4 from major_capsid_protein__Norovirus__AFU92698

SEQ ID NO: 24158 - RNA, 1623 nt, Artificial Sequence
  derived and/or modified sequence opt4 from major_capsid_protein__Norovirus__AFU92699
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucauccuggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccaccagaagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24159 - RNA, 1623 nt, Artificial Sequence
  derived and/or modified sequence opt4 from major_capsid_protein__Norovirus__AFU92700
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24160 - RNA, 1623 nt, Artificial Sequence; identical to SEQ ID NO: 22671
  derived and/or modified sequence opt4 from major_capsid_protein__Norovirus__AFU92701

SEQ ID NO: 24161 - RNA, 1623 nt, Artificial Sequence; identical to SEQ ID NO: 22612
  derived and/or modified sequence opt4 from major_capsid_protein__Norovirus__AFU92702

SEQ ID NO: 24162 - RNA, 1623 nt, Artificial Sequence
  derived and/or modified sequence opt4 from major_capsid_protein__Norovirus__AFU92703
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24163 - RNA, 1623 nt, Artificial Sequence
  derived and/or modified sequence opt4 from major_capsid_protein__Norovirus__AFU92704
augaagauggccagcagcgacgccaaccccagcgacggcagcaccgcccaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24164 - RNA, 1623 nt, Artificial Sequence; identical to SEQ ID NO: 22522
  derived and/or modified sequence opt4 from major_capsid_protein__Norovirus__AFU92705

SEQ ID NO: 24165 - RNA, 1623 nt, Artificial Sequence; identical to SEQ ID NO: 22112
  derived and/or modified sequence opt4 from major_capsid_protein__Norovirus__AFU92706

SEQ ID NO: 24166 - RNA, 1623 nt, Artificial Sequence
  derived and/or modified sequence opt4 from major_capsid_protein__Norovirus__AFU92707
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagaguggaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24167 - RNA, 1623 nt, Artificial Sequence
  derived and/or modified sequence opt4 from major_capsid_protein__Norovirus__AFU92708
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacaugaaccuggacugccugaucccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24168 - RNA, 1623 nt, Artificial Sequence; identical to SEQ ID NO: 22112
  derived and/or modified sequence opt4 from major_capsid_protein__Norovirus__AFU92709

SEQ ID NO: 24169 - RNA, 1623 nt, Artificial Sequence; identical to SEQ ID NO: 22112
  derived and/or modified sequence opt4 from major_capsid_protein__Norovirus__AFU92710

SEQ ID NO: 24170 - RNA, 1623 nt, Artificial Sequence; identical to SEQ ID NO: 22112
  derived and/or modified sequence opt4 from major_capsid_protein__Norovirus__AFU92711

SEQ ID NO: 24171 - RNA, 1623 nt, Artificial Sequence
  derived and/or modified sequence opt4 from major_capsid_protein__Norovirus__AFU92712
augaagauggccagcaacgacgccaaccccagcgagggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcaccaucagauggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauucagcaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagagccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugaucccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24172 - RNA, 1623 nt, Artificial Sequence
  derived and/or modified sequence opt4 from major_capsid_protein__Norovirus__AFU92713
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauucagcaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24173 - RNA, 1623 nt, Artificial Sequence; identical to SEQ ID NO: 22112
  derived and/or modified sequence opt4 from major_capsid_protein__Norovirus__AFU92714

SEQ ID NO: 24174 - RNA, 1623 nt, Artificial Sequence
  derived and/or modified sequence opt4 from major_capsid_protein__Norovirus__AFU92715
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauucagcaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24175 - RNA, 1623 nt, Artificial Sequence
  derived and/or modified sequence opt4 from major_capsid_protein__Norovirus__AFU92717
augaagauggccagcagcgaccccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaagcugaagcugagacccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24176 - RNA, 1623 nt, Artificial Sequence
  derived and/or modified sequence opt4 from major_capsid_protein__Norovirus__AFU92718
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccuggacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24177 - RNA, 1623 nt, Artificial Sequence; identical to SEQ ID NO: 22671
  derived and/or modified sequence opt4 from major_capsid_protein__Norovirus__AFU92719

SEQ ID NO: 24178 - RNA, 1623 nt, Artificial Sequence
  derived and/or modified sequence opt4 from major_capsid_protein__Norovirus__AFU92720
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24179 - RNA, 1623 nt, Artificial Sequence
  derived and/or modified sequence opt4 from major_capsid_protein__Norovirus__AFU92721
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24180 - RNA, 1623 nt, Artificial Sequence
  derived and/or modified sequence opt4 from major_capsid_protein__Norovirus__AFU92722
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24181 - RNA, 1623 nt, Artificial Sequence
  derived and/or modified sequence opt4 from major_capsid_protein__Norovirus__AFU92723
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24182 - RNA, 1647 nt, Artificial Sequence
  derived and/or modified sequence opt4 from major_capsid_protein__Norovirus__AGD79474
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggacagagaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 24183 - RNA, 1647 nt, Artificial Sequence
  derived and/or modified sequence opt4 from major_capsid_protein__Norovirus__AGD79475
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugauccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgugacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggacagagaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24184 - RNA, 1647 nt, Artificial Sequence
  derived and/or modified sequence opt4 from major_capsid_protein__Norovirus__AGD79476
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaccaccaccagagcccacgaggccaagguggacaccaccagcggcagauucacccccaagcugggcagccuggagaucagcaccgagagcgacgacuucgaccagaacaagcccaccagauucacccccgugggcaucggcguggaccacgaggccgacuuccagcaguggacccugcccgacuacgccggccaguucacccacaacaugaaccuggcccccgccguggugcccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24185 - RNA, 1647 nt, Artificial Sequence
  derived and/or modified sequence opt4 from major_capsid_protein__Norovirus__AGD79477
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaccagcaccagagcccacgaggccaagaucgacaccaccagcggcagauucacccccaagcugggcagccuggagaucagcaccgagagcgacgacuucgaccagaacaagcccaccagauucacccccgugggcaucggcguggaccacgagaccgacuuccagcaguggacccugcccgacuacgccggccagcugacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24186 - RNA, 1647 nt, Artificial Sequence
  derived and/or modified sequence opt4 from major_capsid_protein__Norovirus__AGD79478
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacgagacccccuacgaccccgccgagggcauccccggcccccugggcacccccgacuucagaggcaagguguucggcguggccagccagagaaaccccgacaccaccaccagagcccacgaggccaagguggacaccaccagcggcagauucacccccaagcugggcagccuggagaucagcaccgagagcgacgacuucgaccagaacaagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaucaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24187 - RNA, 1647 nt, Artificial Sequence
  derived and/or modified sequence opt4 from major_capsid_protein__Norovirus__AGD79479
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacaccaccaccagagcccacgaggccaagguggacaccaccagcggcagauucacccccaagcugggcagccuggagaucagcaccgagagcgacgacuucgaccagaacaagcccaccagauucacccccgugggcaucggcguggaccacgaggccgacuuccagcaguggacccugcccgacuacgccggccaguucacccacaacaugaaccuggcccccgccguggcccccaacuuccccggcgagcagcugcuguucuucagaagccagcugcccagcagcggcggcagaaccaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaucaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24188 - RNA, 1620 nt, Artificial Sequence
  derived and/or modified sequence opt4 from major_capsid_protein__Norovirus__AGH24750
augaagauggccagcaacgacaccauccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcaugccccugagccccgaccugaaccccuaccugagccaccugagcagaauguacaacggcuacgccggcggcuucgaggugcaggugauccuggccggcaacgccuucaccgccggcaagaucaucuucgccgccaucccccccaacuuccccaccgacggccugagccccagccaggugaccauguucccccacaucaucguggacgugagacagcuggagcccgugcugaucccccugcccgacgugagaaacaacuucuaccacuacaaccaggugaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggacgagaugaccaacagcagauuccccaccccccuggagagacugcacaccggccccaacaacagccugguggugcagccccagaacggcagaugcaccaucgacggcgugcugcugggcaccacccagcugagcgccgugaacaucugcagcuucagaggcgacagcaccaccagagagggccagagccacgccuacaccaugaaccuggccagccagaacuggaccaacuacgaccccaccgaggacauccccgccccccugggcacccccgacuucgugggcaagaucgugggcaugcugagccagaccaccagagagaacagcagcaccagagcccacaaggccaccgugagcaccggcgacgcccacuucaugcccaagcugggcagcgugcuguucaccaccgacaccgaggaccugcagaacggccagaacaccagauucacccccgugggcguggcccaggacggcgagccccaccagaacgagccccagcaguggagacugcccaacuacagcggcacccccggccacaacgugcaccuggccccccccguggcccccaccuuccccggcgagcagcugcuguucuucagaagcaccaugcccggcugcggcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaaggccggcuacaucaccgugagccacaccggccccuacgaccuggugaucccccccaacggcuacuucagauucgacagcugggugaaccaguucuacgcccuggcccccaugggcaccggcaccggcagaagaagagcccuguga

SEQ ID NO: 24189 - RNA, 1623 nt, Artificial Sequence; identical to SEQ ID NO: 22612
  derived and/or modified sequence opt4 from major_capsid_protein__Norovirus__AGI37922

SEQ ID NO: 24190 - RNA, 1623 nt, Artificial Sequence
  derived and/or modified sequence opt4 from major_capsid_protein__Norovirus__AGM46344
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24191 - RNA, 1623 nt, Artificial Sequence
  derived and/or modified sequence opt4 from major_capsid_protein__Norovirus__AGM46347
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24192 - RNA, 1623 nt, Artificial Sequence; identical to SEQ ID NO: 22112
  derived and/or modified sequence opt4 from major_capsid_protein__Norovirus__AGM46349

SEQ ID NO: 24193 - RNA, 1623 nt, Artificial Sequence; identical to SEQ ID NO: 22112
  derived and/or modified sequence opt4 from major_capsid_protein__Norovirus__AGM46355

SEQ ID NO: 24194 - RNA, 1623 nt, Artificial Sequence
  derived and/or modified sequence opt4 from major_capsid_protein__Norovirus__AGM46359
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcagcagcagaaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgacaccgacaccgacaacgacuucgagaccaaccagaacaccaaguucacccccgugggcgugauccaggacggcagcaccaccuacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24195 - RNA, 1623 nt, Artificial Sequence
  derived and/or modified sequence opt4 from major_capsid_protein__Norovirus__AGM46362
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcagcagcagaaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgacaccgacaccgacaacgacuucgagaccaaccagaacaccaaguucacccccgugggcgugauccaggacggcagcaccaccuacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24196 - RNA, 1623 nt, Artificial Sequence
  derived and/or modified sequence opt4 from major_capsid_protein__Norovirus__AGM46366
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagcagaagagcccuguga

SEQ ID NO: 24197 - RNA, 1623 nt, Artificial Sequence; identical to SEQ ID NO: 22112
  derived and/or modified sequence opt4 from major_capsid_protein__Norovirus__AGM46367

SEQ ID NO: 24198 - RNA, 1623 nt, Artificial Sequence
  derived and/or modified sequence opt4 from major_capsid_protein__Norovirus__AGM46370
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24199 - RNA, 1623 nt, Artificial Sequence; identical to SEQ ID NO: 24198
  derived and/or modified sequence opt4 from major_capsid_protein__Norovirus__AGM46375

SEQ ID NO: 24200 - RNA, 1623 nt, Artificial Sequence
  derived and/or modified sequence opt4 from major_capsid_protein__Norovirus__AGM46377
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24201 - RNA, 1623 nt, Artificial Sequence; identical to SEQ ID NO: 24198
  derived and/or modified sequence opt4 from major_capsid_protein__Norovirus__AGM46379

SEQ ID NO: 24202 - RNA, 1623 nt, Artificial Sequence; identical to SEQ ID NO: 24198
  derived and/or modified sequence opt4 from major_capsid_protein__Norovirus__AGM46384

SEQ ID NO: 24203 - RNA, 1623 nt, Artificial Sequence
  derived and/or modified sequence opt4 from major_capsid_protein__Norovirus__AGM46386
augaagaugggcagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24204 - RNA, 1623 nt, Artificial Sequence
  derived and/or modified sequence opt4 from major_capsid_protein__Norovirus__AGM46388
augaagaugggcagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24205 - RNA, 1623 nt, Artificial Sequence
  derived and/or modified sequence opt4 from major_capsid_protein__Norovirus__AGM46392
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcaguuccuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24206 - RNA, 1623 nt, Artificial Sequence; identical to SEQ ID NO: 22612
  derived and/or modified sequence opt4 from major_capsid_protein__Norovirus__AGM46395

SEQ ID NO: 24207 - RNA, 1623 nt, Artificial Sequence
  derived and/or modified sequence opt4 from major_capsid_protein__Norovirus__AGM46398
augaagauggccagcagcgacgccaaccccagcgacggcagcaaggccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagcagaagagcccuguga

SEQ ID NO: 24208 - RNA, 1623 nt, Artificial Sequence; identical to SEQ ID NO: 22112
  derived and/or modified sequence opt4 from major_capsid_protein__Norovirus__AGM46401

SEQ ID NO: 24209 - RNA, 1623 nt, Artificial Sequence; identical to SEQ ID NO: 22112
  derived and/or modified sequence opt4 from major_capsid_protein__Norovirus__AGM46403

SEQ ID NO: 24210 - RNA, 1623 nt, Artificial Sequence
  derived and/or modified sequence opt4 from major_capsid_protein__Norovirus__AGM46407
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24211 - RNA, 1623 nt, Artificial Sequence
  derived and/or modified sequence opt4 from major_capsid_protein__Norovirus__AGM46409
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24212 - RNA, 1623 nt, Artificial Sequence; identical to SEQ ID NO: 23232
  derived and/or modified sequence opt4 from major_capsid_protein__Norovirus__AGM46413

SEQ ID NO: 24213 - RNA, 1623 nt, Artificial Sequence
  derived and/or modified sequence opt4 from major_capsid_protein__Norovirus__AGM46415
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24214 - RNA, 1623 nt, Artificial Sequence
  derived and/or modified sequence opt4 from major_capsid_protein__Norovirus__AGM46419
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcauccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24215 - RNA, 1623 nt, Artificial Sequence
  derived and/or modified sequence opt4 from major_capsid_protein__Norovirus__AGM46421
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24216 - RNA, 1623 nt, Artificial Sequence
  derived and/or modified sequence opt4 from major_capsid_protein__Norovirus__AGM46425
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaguguacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgcccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24217 - RNA, 1623 nt, Artificial Sequence
  derived and/or modified sequence opt4 from major_capsid_protein__Norovirus__AGM46427
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugccccccgugaacaucugcaccuucagaggcgacgugacccacaucgccggcagcagaguguacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgcccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24218 - RNA, 1623 nt, Artificial Sequence; identical to SEQ ID NO: 23336
  derived and/or modified sequence opt4 from major_capsid_protein__Norovirus__AGM46431

SEQ ID NO: 24219 - RNA, 1671 nt, Artificial Sequence
  derived and/or modified sequence opt4 from major_capsid_protein__Norovirus__AGN11430
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagguggugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagccccgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcaacuacgcccccgccaccggcaacaugagauucaccgugagaaacggcggcaccggccacaccagcgccaacaaguacugggaguucaagagcuucggcguggagggcgagagacacaccggcauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagaggcagagugagauuccaguga

SEQ ID NO: 24220 - RNA, 1647 nt, Artificial Sequence
  derived and/or modified sequence opt4 from major_capsid_protein__Norovirus__AGO64038
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgaccccaagcugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagaaccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24221 - RNA, 1623 nt, Artificial Sequence
  derived and/or modified sequence opt4 from major_capsid_protein__Norovirus__AGO64040
augaagauggccagcaacgacgccgcccccagcaacgacggcgccgccggccuggugcccgagaucaacaacgaggugaugccccuggagcccguggccggcgccagccccgccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuucccccacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugaucgccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcugggcaucgacaucugcaaguucaagggcgaggugaucgccaagaacagagacgacagaagcuacagaauggacauggagaucaccaacaccgacggcacccccaucgaccccaccgaggacacccccggccccaucggcagccccgacuucagaggcauccuguucggcguggccagccagagaaacaagaacgagcagaaccccgccaccagaggccacgaggccaacaucaacaccggcggcaaccaguacgcccccaagcuggcccaggugaaguucuucagcgagagcgacgacuucgacgagcaccagcccaccguguucacccccgugggcguggccggcgacgacagccaccccuucagacagugggugcugcccagauacggcggccaccugaccaacaacacccaccuggcccccgccguggccccccuguuccccggcgagcagauccuguucuucagaagccagauccccagcagcggcggcuucgagcugggcuacauggacugccuggugccccaggagugggugcagcacuucuaccaggaggccgccaccgcccagagcgacguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagagugcaguga

SEQ ID NO: 24222 - RNA, 1608 nt, Artificial Sequence
  derived and/or modified sequence opt4 from major_capsid_protein__Norovirus__AGO64042
augaagauggccagcaacgacgccgcccccagcaacgacggcgccgccggccuggugcccgaggccaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacagcuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaugggcgagcugaccaacagcagauuccccgugcccaucgacgagcuguacaccagccccaacgagaaccugguggugcagccccagaacggcagaugcgcccuggacggcgagcugcagggcaccacccagcugcugcccaccgccaucugcagcuucagaggcagagugaaccagaaggugagcggcgagaaccacguguggaacaugcaggugaccaacaucaacggcacccccuucgaccccaccgaggacgugcccgccccccugggcacccccgacuucagcggcagacuguucggcgugcugagccagagagaccacgacaacgccugcagaagccacgacgccgugaucgccaccaacagcaccaaguucacccccaagcugggcgccauccagaucggcaccugggaggaggacgacgugcacaucaaccagcccaccaaguucacccccgugggccuguucgacaccgacgacuucaaccagugggcccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagagcgacguggcccugaucagauucaccaaccccgacaccggcagagugcuguucgaggccaagcugcacagaagcggcuacaucaccguggccaacaccggcaacagacccaucguggugcccgccaacggcuacuucagauucgacagcugggugaaccaguucuacagccuggcccccaugggcaccggcaacggcagaagaagagugcaguga

SEQ ID NO: 24223 - RNA, 1623 nt, Artificial Sequence
  derived and/or modified sequence opt4 from major_capsid_protein__Norovirus__AGS41450
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacaccgaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24224 - RNA, 1623 nt, Artificial Sequence
  derived and/or modified sequence opt4 from major_capsid_protein__Norovirus__AGT62521
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucaugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccaggcccaggaccaggaccccagccagagcgugaccuucgccaccaacgacgccagcuucgugcccuaccugggcagcaucagcccccacaacggcggcgacuuccacgccggcgacaucaucggcagccugggcuggaucagcgcccccagcggcaacagccagcugaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 24225 - RNA, 1629 nt, Artificial Sequence
  derived and/or modified sequence opt4 from major_capsid_protein__Norovirus__AGT62523
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagaaccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagaugagcaacagcagauuccccgugcccaucgaccagauguacaccagccccaacgaggugaucagcgugcagugccagaacggcagaugcacccuggacggcgagcugcagggcaccacccagcugcaggugagcggcaucugcgccuucaagggccaggugaccgcccaccugcaggacaacgagcaccuguacaacgugaccaucaccaaccugaacggcagccccuucgaccccagcgaggacauccccgccccccugggcgugcccgacuucgagggcagaguguucggcgugaucagccagagagacaacuacaacagcggcggccagaaccagcccgccaacagaagccacgacgccguggugcccaccuacaccgcccaguacacccccaagcugggccagauccagaucggcaccuggcagaccgacgacaucaccguggaccagcccgccaaguucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuucggcaaccccgccaucgacugccuggugccccaggaguggauccagcacuucuaccaggaggccgcccccagccugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24226 - RNA, 1623 nt, Artificial Sequence; identical to SEQ ID NO: 23430
  derived and/or modified sequence opt4 from major_capsid_protein__Norovirus__AGV40221

SEQ ID NO: 24227 - RNA, 1623 nt, Artificial Sequence
  derived and/or modified sequence opt4 from major_capsid_protein__Norovirus__AGV76553
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacagcggccagcacgaccuggugaucccccccaacggcuacuucagauucgacagcugggugaaccaguucuacacccuggcccccaugggcaacggcaccggcagaagaagagcccuguga

SEQ ID NO: 24228 - RNA, 1623 nt, Artificial Sequence; identical to SEQ ID NO: 22731
  derived and/or modified sequence opt4 from major_capsid_protein__Norovirus__AGV76554

SEQ ID NO: 24229 - RNA, 1623 nt, Artificial Sequence; identical to SEQ ID NO: 22731
  derived and/or modified sequence opt4 from major_capsid_protein__Norovirus__AGV76555

SEQ ID NO: 24230 - RNA, 1623 nt, Artificial Sequence; identical to SEQ ID NO: 22731
  derived and/or modified sequence opt4 from major_capsid_protein__Norovirus__AGV76556

SEQ ID NO: 24231 - RNA, 1623 nt, Artificial Sequence; identical to SEQ ID NO: 22731
  derived and/or modified sequence opt4 from major_capsid_protein__Norovirus__AGV76557

SEQ ID NO: 24232 - RNA, 1623 nt, Artificial Sequence; identical to SEQ ID NO: 22731
  derived and/or modified sequence opt4 from major_capsid_protein__Norovirus__AGV76558

SEQ ID NO: 24233 - RNA, 1623 nt, Artificial Sequence; identical to SEQ ID NO: 22731
  derived and/or modified sequence opt4 from major_capsid_protein__Norovirus__AGV76559

SEQ ID NO: 24234 - RNA, 1623 nt, Artificial Sequence; identical to SEQ ID NO: 22731
  derived and/or modified sequence opt4 from major_capsid_protein__Norovirus__AGV76560

SEQ ID NO: 24235 - RNA, 1623 nt, Artificial Sequence; identical to SEQ ID NO: 22731
  derived and/or modified sequence opt4 from major_capsid_protein__Norovirus__AGV76561

SEQ ID NO: 24236 - RNA, 1623 nt, Artificial Sequence; identical to SEQ ID NO: 22731
  derived and/or modified sequence opt4 from major_capsid_protein__Norovirus__AGV76562

SEQ ID NO: 24237 - RNA, 1623 nt, Artificial Sequence; identical to SEQ ID NO: 22731
  derived and/or modified sequence opt4 from major_capsid_protein__Norovirus__AGV76563

SEQ ID NO: 24238 - RNA, 1623 nt, Artificial Sequence
  derived and/or modified sequence opt4 from major_capsid_protein__Norovirus__AGV76564
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccagcauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24239 - RNA, 1623 nt, Artificial Sequence; identical to SEQ ID NO: 22731
  derived and/or modified sequence opt4 from major_capsid_protein__Norovirus__AGV76565

SEQ ID NO: 24240 - RNA, 1623 nt, Artificial Sequence; identical to SEQ ID NO: 22731
  derived and/or modified sequence opt4 from major_capsid_protein__Norovirus__AGV76566

SEQ ID NO: 24241 - RNA, 1623 nt, Artificial Sequence
  derived and/or modified sequence opt4 from major_capsid_protein__Norovirus__AGV76567
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24242 - RNA, 1623 nt, Artificial Sequence
  derived and/or modified sequence opt4 from major_capsid_protein__Norovirus__AGV76568
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugaucgacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24243 - RNA, 1623 nt, Artificial Sequence; identical to SEQ ID NO: 22731
  derived and/or modified sequence opt4 from major_capsid_protein__Norovirus__AGV76569

SEQ ID NO: 24244 - RNA, 1623 nt, Artificial Sequence; identical to SEQ ID NO: 22731
  derived and/or modified sequence opt4 from major_capsid_protein__Norovirus__AGV76570

SEQ ID NO: 24245 - RNA, 1623 nt, Artificial Sequence
  derived and/or modified sequence opt4 from major_capsid_protein__Norovirus__AGV76571
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaucaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24246 - RNA, 1623 nt, Artificial Sequence
  derived and/or modified sequence opt4 from major_capsid_protein__Norovirus__AGV76572
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 24247 - RNA, 1623 nt, Artificial Sequence; identical to SEQ ID NO: 22729
  derived and/or modified sequence opt4 from major_capsid_protein__Norovirus__AGV76573

SEQ ID NO: 24248 - RNA, 1623 nt, Artificial Sequence
  derived and/or modified sequence opt4 from major_capsid_protein__Norovirus__AGV76574
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 24249 - RNA, 1623 nt, Artificial Sequence
  derived and/or modified sequence opt4 from major_capsid_protein__Norovirus__AGV76575
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacaacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 24250 - RNA, 1623 nt, Artificial Sequence; identical to SEQ ID NO: 22729
  derived and/or modified sequence opt4 from major_capsid_protein__Norovirus__AHA44844

SEQ ID NO: 24251 - RNA, 1623 nt, Artificial Sequence
  derived and/or modified sequence opt4 from major_capsid_protein__Norovirus__AHA44847
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaucguguacaccggcagcgccgacuucgcccccaagcugggcagagugcaguucgagaccgacaccgaccacgacuucgaggccaaccagaacaccaaguucacccccgugggcgugacccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagugguguga

SEQ ID NO: 24252 - RNA, 1623 nt, Artificial Sequence
  derived and/or modified sequence opt4 from major_capsid_protein__Norovirus__AHB62404
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagcaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcgccaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24253 - RNA, 1623 nt, Artificial Sequence; identical to SEQ ID NO: 22731
  derived and/or modified sequence opt4 from major_capsid_protein__Norovirus__AHB62406

SEQ ID NO: 24254 - RNA, 1623 nt, Artificial Sequence
  derived and/or modified sequence opt4 from major_capsid_protein__Norovirus__AID51515
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcccggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaagcgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24255 - RNA, 1623 nt, Artificial Sequence; identical to SEQ ID NO: 22723
  derived and/or modified sequence opt4 from major_capsid_protein__Norovirus__AID51517

SEQ ID NO: 24256 - RNA, 1623 nt, Artificial Sequence
  derived and/or modified sequence opt4 from major_capsid_protein__Norovirus__AID51519
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcagauacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24257 - RNA, 1623 nt, Artificial Sequence
  derived and/or modified sequence opt4 from major_capsid_protein__Norovirus__AID51522
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24258 - RNA, 1623 nt, Artificial Sequence; identical to SEQ ID NO: 22729
  derived and/or modified sequence opt4 from major_capsid_protein__Norovirus__AID51531

SEQ ID NO: 24259 - RNA, 1623 nt, Artificial Sequence; identical to SEQ ID NO: 22675
  derived and/or modified sequence opt4 from major_capsid_protein__Norovirus__AID51534

SEQ ID NO: 24260 - RNA, 1623 nt, Artificial Sequence; identical to SEQ ID NO: 22675
  derived and/or modified sequence opt4 from major_capsid_protein__Norovirus__AIL49840

SEQ ID NO: 24261 - RNA, 1623 nt, Artificial Sequence
  derived and/or modified sequence opt4 from major_capsid_protein__Norovirus__AIL49843
augaagauggccagcagcgacgccaaccccagcgacggcagcgccgccaaccuggugcccgaggugaacaacgaggugauggcccuggagcccuucgugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccugaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaagcgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24262 - RNA, 1623 nt, Artificial Sequence
  derived and/or modified sequence opt4 from major_capsid_protein__Norovirus__AIV99914
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaaccuacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgccagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacagcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgugccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccagggcgccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccguguga

SEQ ID NO: 24263 - RNA, 1635 nt, Artificial Sequence
  derived and/or modified sequence opt4 from major_capsid_protein__Norovirus__AJP13619
auggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagaggcagacugggcgugagaagaaucuga

SEQ ID NO: 24264 - RNA, 1632 nt, Artificial Sequence
  derived and/or modified sequence opt4 from major_capsid_protein__Norovirus__AJP13620
auggccagcaaggacgcccccaccaacauggacggcaccagcggcgccggccagcuggugcccgaggccaacaccgccgagcccaucagcauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcaucccccccggcuucguggcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcauccuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacaagagagacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacaccagcggcaccggcccccagacccugcccaucaacggcguguucguguucgugagcugggugagcagauucuaccagcugaagcccgugggcaccgccggccccgccagaagacugggcaucagaagaagcuga

SEQ ID NO: 24265 - RNA, 1647 nt, Artificial Sequence
  derived and/or modified sequence opt4 from major_capsid_protein__Norovirus__AJP13621
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucagccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcaccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagaucgacaccaccagcggcagauucacccccaagcugggcagccuggagaucagcaccgagagcgacgacuucgaccagaacaagcccaccagauucacccccgugggcaucggcguggaccacgaggccgacuuccagcagugggcccugcccgacuacgccggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccagccagagccagguggcccuggugagauacaucaaccccgacaccggcagagugcuguucgaggccaagcugcacaagcugggcuucaucaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24266 - RNA, 1653 nt, Artificial Sequence
  derived and/or modified sequence opt4 from major_capsid_protein__Norovirus__AJP13622
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagcaccgacuucaccaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuucggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24267 - RNA, 1614 nt, Artificial Sequence
  derived and/or modified sequence opt4 from major_capsid_protein__Norovirus__AJP13623
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgacaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccgacagcgccaaguucacccccaagcugggcgccauccagaucggcaccugggaggaggacgacgugcacaucaaccagcccaccaaguucacccccgugggccuguucgagagagagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagauucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcagaagggcuga

SEQ ID NO: 24268 - RNA, 1623 nt, Artificial Sequence
  derived and/or modified sequence opt4 from major_capsid_protein__Norovirus__AJW67354
augaugauggccagcaaggacgcccccaccagccccgacggcgccagcggcgccggccagcuggugcccgaggccaacaccgccgagcagaucagcauggaccccguggccggcgccagcaccgccguggccaccgccggccaggugaacaugaucgaccccuggaucuucaacaacuucgugcaggccccccagggcgaguucaccaucagccccaacaacacccccggcgacauccuguucgaccugcagcugggcccccaccugaaccccuuccuggcccaccugagccagauguacaacggcugggugggcaacaugagagugagaauccugcuggccggcaacgccuucaccgccggcaagaucaucaucugcugcgugccccccggcuucgacgccagaauccugaccaucgcccaggccacccuguucccccaccugaucgccgacgugagaacccuggagcccguggagcugccccuggaggacgugagaaacgugcuguaccacaacagcagccagccccagcccaccaugagacugguggccaugcuguacaccccccugagaaccggcggcggcagcggcggcaccgacgccuucgugguggccggcagagugcugaccugccccgcccccgacuucagcuuccuguuccuggugccccccagcguggagcagaagaccagaguguucagcgugcccaacaucccccugaaggaccugagcaacagcagagugcccgugcccgugcagggcauguucgugagccccgacgugaaccagagcgugcaguuccagaacggcagaugccagaucgacggccagcugcagggcaccacccccgugagccugagccagcugugcaagaucagaggcaagaccagcagcaacgccagagugcugaaccugagcgagguggacggcacccccuucaucccccuggagagccccgcccccgugggcuuccccgaccugggcggcugcgacuggcacgugaacuucaccuuccagacccaggacagagaccccagccagagcgugaccuucgccaccaacgacgccagcuucgugcccuaccugggcagcgugagcccccacaacggcgagggcuuccaggccggcgacaucaucggcagccugggcuggaucagcgcccccagcgacaacagccaguucaacgugugggccauccccaaguacggcagcagccugcccgacgugacccaccuggcccccgccguguucccccccggcuucggcgaggugauccuguacuucuacagcaccuuccccggcagcggccagcccagccagcugcaggugcccugccugcugccccaggaguucaucacccacuucugcaacgagcaggcccccaucgccggcgaggccgcccugcugcacuacguggaccccgacaccggcagaaaccugggcgaguucaagcuguaccccgacggcuucaugaccugcgugcccaacagcgugagcagcggcccccagacccugcccaucaacggcguguucguguucgugagcugggugagcagauucuaccagcugaagcccgugggcaccgccagcgccgccagaagacugggccugagaagaaucuga

SEQ ID NO: 24269 - RNA, 1644 nt, Artificial Sequence
  derived and/or modified sequence opt4 from major_capsid_protein__Norovirus__AJW67357
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugauguacagcgagagcagcgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucgugaccguggccaacagcggcaacaaccccaucguggugccccccaacggcuacuucagauucgaggccugggugaaccaguucuacacccugacccccaugggcaccggccagggcagaagaagaauccaguga

SEQ ID NO: 24270 - RNA, 1644 nt, Artificial Sequence
  derived and/or modified sequence opt4 from major_capsid_protein__Norovirus__AJW67359
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccaggccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggcccacaucgacaccaccaaccccagauacacccccaagcugggcagcgugcugauguacagcgagagcagcgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24271 - RNA, 1644 nt, Artificial Sequence
  derived and/or modified sequence opt4 from major_capsid_protein__Norovirus__AJW67362
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugauguacagcgagagcaccgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24272 - RNA, 1617 nt, Artificial Sequence; identical to SEQ ID NO: 23838
  derived and/or modified sequence opt4 from major_capsid_protein__Norovirus__AJW67368

SEQ ID NO: 24273 - RNA, 1617 nt, Artificial Sequence; identical to SEQ ID NO: 23838
  derived and/or modified sequence opt4 from major_capsid_protein__Norovirus__AJW67371

SEQ ID NO: 24274 - RNA, 1623 nt, Artificial Sequence
  derived and/or modified sequence opt4 from major_capsid_protein__Norovirus__AJW67374
auggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcagauucacccccaagaucggcaccaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcaacuacccccugguggugccccccaacggccacuucagauucgacagcugggugaaccaguucuacagccuggcccccaugggcaccggcaacggcagaagaagagugcaguga

SEQ ID NO: 24275 - RNA, 1635 nt, Artificial Sequence
  derived and/or modified sequence opt4 from major_capsid_protein__Norovirus__AJW67377
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgagaugagcaagauccccaacagcagcaccgagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccaacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacugggcgugagaagauga

SEQ ID NO: 24276 - RNA, 1617 nt, Artificial Sequence
  derived and/or modified sequence opt4 from major_capsid_protein__Norovirus__AJX18190
auggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccccccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 24277 - RNA, 1617 nt, Artificial Sequence; identical to SEQ ID NO: 23838
  derived and/or modified sequence opt4 from major_capsid_protein__Norovirus__AJX18193

SEQ ID NO: 24278 - RNA, 1623 nt, Artificial Sequence; identical to SEQ ID NO: 22852
  derived and/or modified sequence opt4 from major_capsid_protein__Norovirus__AJZ77004

SEQ ID NO: 24279 - RNA, 1623 nt, Artificial Sequence; identical to SEQ ID NO: 22573
  derived and/or modified sequence opt4 from major_capsid_protein__Norovirus__AJZ77010

SEQ ID NO: 24280 - RNA, 1623 nt, Artificial Sequence
  derived and/or modified sequence opt4 from major_capsid_protein__Norovirus__AJZ77013
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24281 - RNA, 1623 nt, Artificial Sequence; identical to SEQ ID NO: 22583
  derived and/or modified sequence opt4 from major_capsid_protein__Norovirus__AJZ77015

SEQ ID NO: 24282 - RNA, 1623 nt, Artificial Sequence; identical to SEQ ID NO: 22581
  derived and/or modified sequence opt4 from major_capsid_protein__Norovirus__AJZ77019

SEQ ID NO: 24283 - RNA, 1623 nt, Artificial Sequence; identical to SEQ ID NO: 22675
  derived and/or modified sequence opt4 from major_capsid_protein__Norovirus__AJZ77022

SEQ ID NO: 24284 - RNA, 1623 nt, Artificial Sequence; identical to SEQ ID NO: 22947
  derived and/or modified sequence opt4 from major_capsid_protein__Norovirus__AJZ77027

SEQ ID NO: 24285 - RNA, 1623 nt, Artificial Sequence; identical to SEQ ID NO: 22729
  derived and/or modified sequence opt4 from major_capsid_protein__Norovirus__AJZ77030

SEQ ID NO: 24286 - RNA, 1623 nt, Artificial Sequence; identical to SEQ ID NO: 22072
  derived and/or modified sequence opt4 from major_capsid_protein__Norovirus__AJZ77033

SEQ ID NO: 24287 - RNA, 1623 nt, Artificial Sequence; identical to SEQ ID NO: 22072
  derived and/or modified sequence opt4 from major_capsid_protein__Norovirus__AJZ77036

SEQ ID NO: 24288 - RNA, 1623 nt, Artificial Sequence
  derived and/or modified sequence opt4 from major_capsid_protein__Norovirus__AKE31849
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccaggccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24289 - RNA, 1623 nt, Artificial Sequence
  derived and/or modified sequence opt4 from major_capsid_protein__Norovirus__AKE31852
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgugggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuuccaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagaauccaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24290 - RNA, 1623 nt, Artificial Sequence
  derived and/or modified sequence opt4 from major_capsid_protein__Norovirus__AKE31855
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucguggugcaggugauccuggccggcaacgccuucaccgccggcaagaucaucuucgccgccgugccccccaacuuccccaccgagggccugagccccagccaggugaccauguucccccacaucaucguggacgccagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24291 - RNA, 1623 nt, Artificial Sequence
  derived and/or modified sequence opt4 from major_capsid_protein__Norovirus__AKE31858
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagacccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagagacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacagacugcugccccaggagugggugcaguacuucuaccaggagcccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24292 - RNA, 1623 nt, Artificial Sequence
  derived and/or modified sequence opt4 from major_capsid_protein__Norovirus__AKE31861
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccagacuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguuccacacccuggcccccaugggcaacggcaccggcagaagaagagcccuguga

SEQ ID NO: 24293 - RNA, 1623 nt, Artificial Sequence
  derived and/or modified sequence opt4 from major_capsid_protein__Norovirus__AKE31864
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucagaaccuucagaggcgacgugacccacauccccggcagcagaaacuacaccaugaacagcgccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24294 - RNA, 1623 nt, Artificial Sequence
  derived and/or modified sequence opt4 from major_capsid_protein__Norovirus__AKE31867
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugagcaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24295 - RNA, 1623 nt, Artificial Sequence
  derived and/or modified sequence opt4 from major_capsid_protein__Norovirus__AKE31870
augaagauggccagcagcgacgccaaccccagcgacggcagcaccgccaaccuggugcccgaggugaacaacgaggugauggcccuggagcccguggugggcgccagcaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugccccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacuaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagagccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24296 - RNA, 1623 nt, Artificial Sequence
  derived and/or modified sequence opt4 from major_capsid_protein__Norovirus__AKE31873
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcaguggaugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24297 - RNA, 1623 nt, Artificial Sequence
  derived and/or modified sequence opt4 from major_capsid_protein__Norovirus__AKE31876
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccagagacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccaacuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24298 - RNA, 1632 nt, Artificial Sequence
  derived and/or modified sequence opt4 from major_capsid_protein__Norovirus__AKF02368
augaagauggccagcaacgacgccgcccccagcaacgacggcgccgccggccuggugcccgagaucaacaacgagaccauggcccuggagcccguggccggcggcgccaucgccgccccccugaccggccagaccaacuucaucgaccccuggaucagaggcaacuacgugcaggcccccaacggcgaguucaccgugagccccagaaacagccccggcgagauccugcugaaccuggagcugggccccgagcugaaccccuuccugagccaccugagcagaauguacaacggcuacgccggcggcaucgacgugcaggugaucauggccggcaacgccuucaccgccggcaagaucaucuucgccgccauccccccccacuuccccguggagaaccugagccccccccagaucaccauguucccccacaucaucguggacgugagaacccuggagcccaucaacauccccgugcccgacgugagaaacaacuucuuccacuacaaccagaacaacgagagcagaaugagacugguggccaugcuguacaccccccugagaagcaacggcagcgccgaggacguguucaccgugagcugcagagugcugaccaagcccagcgccgacuucgaguucaacuaccuggugccccccaccguggagagcagaaccaagcccuucaccauccccauccugaccaucggcgagaugaccaacagcagauuccccgugcccaucgacaugcugcacaccagccccaccgagaacaucguggugcagccccagaacggcagaugcaccaucgacggcgagcugcugggcaccacccagcugaucaccagcaacaucugcagcuucagaggcagcaucagcggccacgagggcaacgacgaccagcaccuguggcacuucaacaucaccaaccccaacggcacccccuucgaccccaccgaggacgugcccgccccccugggcacccccgacuucagaggccagcuguacggcgugaucagccagagagacagagagggcacccccagcgagaacaaccagaaggccaacagaagccacgagggcgugaucagcaccaucagccccaaguucgugcccaagcugggcagcgugaugaucggcaccuggaccaccgacgacaucaagaaccagcccagcaaguucacccccaucggccugaacgacgacgacaacuucaagcagugggagcugcccaacuacagcggcgcccugacccugaacaugggccuggcccccagcguguuccccaccuaccccggcgagcaggugcuguucuucagaagcuaccugcccaugaagggcggcuacggcagccccuucaucgacugccuggugccccaggaguggguggcccacuucuaccaggagagcgcccccgcccagaccgacguggcccugaucagauacgugaaccccgagaccggcagagugcuguucgaggccaagcugcacagacagggcuucaucaccguggccaagagcggcgacagccccaucaacgugcccgccaacggcuacuucagauucgacagcugggugaaccaguucuacagccuggcccccaugggcaccggcaacggcagaagaagaauccaguga

SEQ ID NO: 24299 - RNA, 1644 nt, Artificial Sequence
  derived and/or modified sequence opt4 from major_capsid_protein__Norovirus__AKF42429
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugauguacagcgagagcaccgacuucgacgacggccagcccaccagauucacccccaucggcaugggcgccgacgacuggcaccagugggagcugcccgaguacagcggccaccugacccugagcaugagccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24300 - RNA, 1644 nt, Artificial Sequence
  derived and/or modified sequence opt4 from major_capsid_protein__Norovirus__AKF42434
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugauguacagcgagagcagcgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24301 - RNA, 1650 nt, Artificial Sequence
  derived and/or modified sequence opt4 from major_capsid_protein__Norovirus__AKF42437
augaagauggccagcaccgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccgugaagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcgugguggugcagccccagaacggcagaugcacccuggacggcacccugcagggcaccacccagcuggugcccacccagaucugcgccuucagaggcaagcugaucggccagaccagcagaagccccgacagcgacagcaccgacagcgcccccagaagaagagaccacccccugcacgugcagcuggagaaccuggacggcacccaguacgaccccaccgacgaggugcccgccacccugggcgccguggacuucaagggcaccaucuucggcguggccagccagagagacaccagcggcagccaggugggcgccaccagagcccacgaggugcacaucaacaccaccgaccccagauacacccccaagcugggcagcauccugauguacagcgagagccuggacuucgagaccggccagcccgugagauucacccccaucggcaugggcgagaacgacuggcaccagugggagcugcccgacuacagcggcagacugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 24302 - RNA, 1623 nt, Artificial Sequence; identical to SEQ ID NO: 22522
  derived and/or modified sequence opt4 from major_capsid_protein__Norovirus__ALA27427

SEQ ID NO: 24303 - RNA, 1623 nt, Artificial Sequence
  derived and/or modified sequence opt4 from major_capsid_protein__Norovirus__ALD09618
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgccagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24304 - RNA, 1623 nt, Artificial Sequence
  derived and/or modified sequence opt4 from major_capsid_protein__Norovirus__ALM96644
augaagauggccagcagcgacgccaaccccagcgacggcagcaccgccaaccugauccccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacaucuucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24305 - RNA, 1623 nt, Artificial Sequence
  derived and/or modified sequence opt4 from major_capsid_protein__Norovirus__ALM96645
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcggcgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaaggugcagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccgugagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24306 - RNA, 1623 nt, Artificial Sequence
  derived and/or modified sequence opt4 from major_capsid_protein__Norovirus__ALM96646
augaagauggccagcaacgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcaaguucaccgugagccccaagaacgcccccggcgagauccuguggagcgccccccugggccccgaccugaaccccuaccugagccaccuggccagaauguacaagggccacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24307 - RNA, 1623 nt, Artificial Sequence
  derived and/or modified sequence opt4 from major_capsid_protein__Norovirus__ALM96647
augaagauggccagcaacgacgccaaccccagcgacggcagcgccgccaaccuggugcccaaggugaacaacgaggugauggcccuggagcccguggugggcgccgccaucgccgcccccguggccggccagcagaacgugaucgaccccuggaucagaaacaacuucgugcaggcccccggcggcaaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24308 - RNA, 1623 nt, Artificial Sequence; identical to SEQ ID NO: 23050
  derived and/or modified sequence opt4 from major_capsid_protein__Norovirus__ALM98891

SEQ ID NO: 24309 - RNA, 1623 nt, Artificial Sequence; identical to SEQ ID NO: 23050
  derived and/or modified sequence opt4 from major_capsid_protein__Norovirus__ALM98892

SEQ ID NO: 24310 - RNA, 1623 nt, Artificial Sequence; identical to SEQ ID NO: 23050
  derived and/or modified sequence opt4 from major_capsid_protein__Norovirus__ALM98893

SEQ ID NO: 24311 - RNA, 1623 nt, Artificial Sequence; identical to SEQ ID NO: 23050
  derived and/or modified sequence opt4 from major_capsid_protein__Norovirus__ALM98894

SEQ ID NO: 24312 - RNA, 1623 nt, Artificial Sequence; identical to SEQ ID NO: 23050
  derived and/or modified sequence opt4 from major_capsid_protein__Norovirus__ALM98895

SEQ ID NO: 24313 - RNA, 1623 nt, Artificial Sequence; identical to SEQ ID NO: 22409
  derived and/or modified sequence opt4 from major_capsid_protein__Norovirus__ALM98896

SEQ ID NO: 24314 - RNA, 1623 nt, Artificial Sequence; identical to SEQ ID NO: 23050
  derived and/or modified sequence opt4 from major_capsid_protein__Norovirus__ALM98897

SEQ ID NO: 24315 - RNA, 1623 nt, Artificial Sequence; identical to SEQ ID NO: 23050
  derived and/or modified sequence opt4 from major_capsid_protein__Norovirus__ALM98899

SEQ ID NO: 24316 - RNA, 1623 nt, Artificial Sequence; identical to SEQ ID NO: 22727
  derived and/or modified sequence opt4 from major_capsid_protein__Norovirus__ALM98901

SEQ ID NO: 24317 - RNA, 1623 nt, Artificial Sequence
  derived and/or modified sequence opt4 from major_capsid_protein__Norovirus__ALM98907
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacauccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24318 - RNA, 1623 nt, Artificial Sequence
  derived and/or modified sequence opt4 from major_capsid_protein__Norovirus__ALM98910
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggacgccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24319 - RNA, 1623 nt, Artificial Sequence
  derived and/or modified sequence opt4 from major_capsid_protein__Norovirus__ALM98913
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaagcacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24320 - RNA, 1623 nt, Artificial Sequence; identical to SEQ ID NO: 22918
  derived and/or modified sequence opt4 from major_capsid_protein__Norovirus__ALM98916

SEQ ID NO: 24321 - RNA, 1623 nt, Artificial Sequence
  derived and/or modified sequence opt4 from major_capsid_protein__Norovirus__ALT54478
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24322 - RNA, 1617 nt, Artificial Sequence
  derived and/or modified sequence opt4 from major_capsid_protein__Norovirus__ALT54488
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaacaugaucgaccccuggaucaugaacaacuucgugcaggcccccgagggcgaguucaccaucagccccaacaacacccccggcgacauccuguucgaccugagacugggcccccaccugaaccccuuccugcugcaccugagccagauguacaacggcugggugggcaacaugagagugagagugaugcuggccggcaacgccuucagcgccggcaagaucaucaucugcugcgugccccccggcuucgagagccagaacaucagcaucggccaggccaccauguucccccacgugaucgccgacgugagagugcuggagcccaucgaggugccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccgcccccgacuucaacuuccuguuccuggugccccccagcguggagcagaagaccagacagcugaccauccccaacaucccccugaacaaccuggccaacagcagagugcccgccaugaucaacaagaugaccgugagcgccgaccagaaccagguggugcaguuccagaacggcagaugcacccuggagggccagcugcugggcaccacccccgugagcgccaaccagguggccagaaucagaggcaagguguucagcaccaacagcggcaccggccugaaccugaccgagguggacggcacccccuaccacgccuucgagagccccgccccccugggcuuccccgacaucggcaacugcgacuggcacguguacgccuucaaggugaaccagaacaccggcgaccccauguacagacuggacaucacccagggcaacagcuucgccccccaccugggcagcaucgaguucagcagcgagaaccaccccagcggcgaccagcugggcacccugaccuggaucagcccccugaacaacgccagcagaguggaccccuggaagauccccaccuacggcagcacccugaccgagagcaccaaccuggccccccccaucuucccccccggcuucggcgagagcaucguguacuucaugagcgacuuccccaucgugagcggcaacaccgcccagauccccugcacccugccccaggaguucgugagcagcuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccagcaacggcguguucguguucagcagcugggugagcagauacuaccagcugaagcccgugggcaccaccggccccgugagaagacugggcgugagaagaguguga

SEQ ID NO: 24323 - RNA, 1620 nt, Artificial Sequence
  derived and/or modified sequence opt4 from major_capsid_protein__Norovirus__ALT54491
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccagaucgccagcacccagaccuacaccaugaaccuggccagccugaacuggaacaacuacgaccccaccgaggagauccccgccccccugggcgcccccgacuucaugggcaagauccagggcgugcugacccagaccaccagacagggcggcagcaccagaggccacaaggccaccgugagcaccggcagcgugcacuucacccccaagcugggcagcgugagauucgacaccgacaccaacaacgaccugcagccccaccagagcaccagauucacccccgugggcgugauccaggacggcgacacccaccagaacgagccccagcagugggcccugcccugcuacagcggcagagacgugaacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacaaccuggugaucccccccaacggcuacuucagauucgacagcugggugaaccaguucuacacccuggcccccaugggcaacggcaccggcagaagaagagugcuguga

SEQ ID NO: 24324 - RNA, 1620 nt, Artificial Sequence
  derived and/or modified sequence opt4 from major_capsid_protein__Norovirus__ALT54494
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccagaucgccagcacccagaccuacaccaugaaccuggccagccugaacuggaacaacuacgaccccaccgaggagauccccgccccccugggcgcccccgacuucaugggcaagauccagggcgugcugacccagaccaccagacaggacggcagcaccagaggccacaaggccaccgugagcaccggcagcgugcacuucacccccaagcugggcagcgugagauucgacaccgacaccaacaacaaccugcagccccaccagagcaccagauucacccccgugggcgugauccaggacggcgacacccaccagaacgagccccagcagugggugcugcccugcuacagcggcagagacgugaacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacaaccuggugaucccccccaacggcuacuucagauucgacagcugggugaaccaguucuacacccuggcccccaugggcaacggcaccggcagaagaagagugcuguga

SEQ ID NO: 24325 - RNA, 1620 nt, Artificial Sequence
  derived and/or modified sequence opt4 from major_capsid_protein__Norovirus__BAM65003
augaugauggccagcaaggacgcccccagcaacauggacggcaccagcggcgccggccagcuggugcccgaggugaacgccgccgagccccugccccuggagcccguggugggcgccgccaccgccgccgccaccgccggccaggugaaccugaucgaccccuggaucaugaacaacuucgugcaggcccccgagggcgaguucaccaucagccccaacaacacccccggcgacauccuguucgaccugcagcugggcccccaccugaaccccuuccugcagcaccugagccagauguacaacggcugggugggcaacaugagagugagagugaugcuggccggcaacgccuucaccgccggcaagaucaucaucugcugcgugccccccggcuucgccagccagaacaucagcaucggccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcagcggcaccgaccccuucgugaucgccggcagagugcugaccugccccagccccgacuucaacuuccuguuccuggugccccccagcguggagcagaagaccagacagcugaccgugcccaacaucccccugaacaaccuggccaacagcagagugcccgccaugaucaacaagaugaccgugagcaccgaccagaaccagguggugcaguuccagaacggcagaugcacccuggagggccagcugcugggcaccacccccgugagcgccagccagguggccagaaucagaggcaagguguucagcaccgccagcggcaagggccugaaccugaccgagcuggacggcacccccuaccacgccuucgagagccccgccccccugggcuuccccgacaucggcgccugcgacuggcacgugagcaccuucaagguggaccagaaccugagcggcgaccccaugagcagacuggacaucaagcagaacgcccccuucgccccccaccugggcagcaucgaguucaccagcgaccaggagcccaccggcgaccagcugggcacccuggccugggugagccccagcaccagcggcgccagaguggaccccuggaagauccccagcuacggcagcaccgugaccgagagcacccaccuggccccccccaucuucccccccggcuucggcgaggccaucguguacuucaugagcgacuuccccaucgugagcggcaacaccgcccaggugcccugcacccugccccaggaguucgugagccacuucguggagcagcaggcccccaucagaggcgaggccgcccugcugcacuacguggaccccgacacccacagaaaccugggcgaguucaagcuguaccccgacggcuucaucaccugcgugcccaacaccggcggcggcccccagaaccugcccaucaacggcguguucguguucagcagcugggugagcagauacuaccagcugaagcccgugggcaccgccggccccgccagaagacugggcgugagaagaguguga

SEQ ID NO: 24326 - RNA, 1647 nt, Artificial Sequence
  derived and/or modified sequence opt4 from major_capsid_protein__Norovirus__BAM65005
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 24327 - RNA, 1644 nt, Artificial Sequence
  derived and/or modified sequence opt4 from major_capsid_protein__Norovirus__BAM65007
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcaccguguucggcguggccagccagagagacgugagcggccagcaggugggcgccaccagagcccacgaggugcacaucaacaccaccgaccccagauacacccccaagcugggcagcauccugaugcacagcgagagcgacgacuucgugaccggccagcccgugagauucacccccaucggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 24328 - RNA, 1623 nt, Artificial Sequence; identical to SEQ ID NO: 22072
  derived and/or modified sequence opt4 from major_capsid_protein__Norovirus__CCX28604

SEQ ID NO: 24329 - RNA, 1623 nt, Artificial Sequence
  derived and/or modified sequence opt4 from major_capsid_protein__Norovirus__CCX28607
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcuggugccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgaggccaaccagaacaccaaguucacccccgugggcgugauccaggacggcagcaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24330 - RNA, 1623 nt, Artificial Sequence
  derived and/or modified sequence opt4 from major_capsid_protein__Norovirus__CCX28619
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24331 - RNA, 1623 nt, Artificial Sequence
  derived and/or modified sequence opt4 from major_capsid_protein__Norovirus__CCX28622
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccgcccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24332 - RNA, 1623 nt, Artificial Sequence; identical to SEQ ID NO: 24330
  derived and/or modified sequence opt4 from major_capsid_protein__Norovirus__CCX28625

SEQ ID NO: 24333 - RNA, 1623 nt, Artificial Sequence; identical to SEQ ID NO: 24331
  derived and/or modified sequence opt4 from major_capsid_protein__Norovirus__CCX28628

SEQ ID NO: 24334 - RNA, 1623 nt, Artificial Sequence; identical to SEQ ID NO: 22072
  derived and/or modified sequence opt4 from major_capsid_protein__Norovirus__CCX28631

SEQ ID NO: 24335 - RNA, 1623 nt, Artificial Sequence; identical to SEQ ID NO: 24330
  derived and/or modified sequence opt4 from major_capsid_protein__Norovirus__CCX28634

SEQ ID NO: 24336 - RNA, 1623 nt, Artificial Sequence
  derived and/or modified sequence opt4 from major_capsid_protein__Norovirus__CCX28637
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24337 - RNA, 1623 nt, Artificial Sequence; identical to SEQ ID NO: 22072
  derived and/or modified sequence opt4 from major_capsid_protein__Norovirus__CCX28640

SEQ ID NO: 24338 - RNA, 1623 nt, Artificial Sequence; identical to SEQ ID NO: 24330
  derived and/or modified sequence opt4 from major_capsid_protein__Norovirus__CCX28643

SEQ ID NO: 24339 - RNA, 1623 nt, Artificial Sequence; identical to SEQ ID NO: 22072
  derived and/or modified sequence opt4 from major_capsid_protein__Norovirus__CCX28646

SEQ ID NO: 24340 - RNA, 1623 nt, Artificial Sequence; identical to SEQ ID NO: 22264
  derived and/or modified sequence opt4 from major_capsid_protein__Norovirus__CCX28649

SEQ ID NO: 24341 - RNA, 1623 nt, Artificial Sequence; identical to SEQ ID NO: 24331
  derived and/or modified sequence opt4 from major_capsid_protein__Norovirus__CCX28652

SEQ ID NO: 24342 - RNA, 1626 nt, Artificial Sequence; identical to SEQ ID NO: 22427
  derived and/or modified sequence opt4 from major_capsid_protein_VP1__Norovirus__AEE10000

SEQ ID NO: 24343 - RNA, 1626 nt, Artificial Sequence; identical to SEQ ID NO: 22430
  derived and/or modified sequence opt4 from major_capsid_protein_VP1__Norovirus__AEE10012

SEQ ID NO: 24344 - RNA, 1623 nt, Artificial Sequence; identical to SEQ ID NO: 22997
  derived and/or modified sequence opt4 from major_capsid_protein_VP1__Norovirus__AGJ52172

SEQ ID NO: 24345 - RNA, 1623 nt, Artificial Sequence; identical to SEQ ID NO: 22921
  derived and/or modified sequence opt4 from major_capsid_protein_VP1__Norovirus__AGJ52173

SEQ ID NO: 24346 - RNA, 1623 nt, Artificial Sequence; identical to SEQ ID NO: 22731
  derived and/or modified sequence opt4 from major_capsid_protein_VP1__Norovirus__AGJ52174

SEQ ID NO: 24347 - RNA, 1632 nt, Artificial Sequence; identical to SEQ ID NO: 23051
  derived and/or modified sequence opt4 from major_capsid_protein_VP1__Norovirus__AGJ52176

SEQ ID NO: 24348 - RNA, 1608 nt, Artificial Sequence
  derived and/or modified sequence opt4 from major_capsid_region__Norovirus__ADO85555
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccgugcccccccacuucccccuggagaacaucagccccggccagaucaccauguucccccacgugaucaucgacgugagaacccuggagcccgugcugcugccccugcccgacgugagaaacaacuucuuccacuacaaccagcagaacgagcccuggaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucacccugcccauccugaccaucggcgagcugaccaacagcagauuccccgugcccaucgacgagcuguacaccagccccaacgagagccugguggugcagccccagaacggcagaugcgcccuggacggcgagcugcagggcaccacccagcugcugcccaccgccaucugcagcuucagaggcagaaucaaccagaaggugagcggcgagaaccacguguggaacaugcaggugaccaacaucaacggcacccccuucgaccccaccgaggacgugcccgccccccugggcacccccgacuucagcggcaagcuguucggcgugcugagccagagagaccacgacaacgccugcagaagccacgacgccgugaucgccaccaacagcgccaaguucacccccaagcugggcgccauccagaucggcaccugggaggagaacgacgugcacaucaaccagcccaccaaguucacccccgugggccuguucgagagcgagggcuucaaccaguggacccugcccaacuacagcggcgcccugacccugaacaugggccuggccccccccguggcccccaccuuccccggcgagcagauccuguucuucagaagccacaucccccugaagggcggcguggccgaccccgugaucgacugccugcugccccaggaguggauccagcaccuguaccaggagagcgcccccagccagaccgacguggcccugaucagaaucaccaaccccgacaccggcagagugcuguucgaggccaagcugcacagaagcggcuacaucaccguggccaacaccggcagcagacccaucguggugcccgccaacggcuacuucagauucgacagcugggugaaccaguucuacagccuggcccccaugggcaccggcaacggcagaagaagagugcaguga

SEQ ID NO: 24349 - RNA, 1626 nt, Artificial Sequence
  derived and/or modified sequence opt4 from majore_capsid_protein__Norovirus__AFO84035
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagagcccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguaccagagcgaggugggcgagguggccaccuucacccugaucgagcaggacggcagcgccuacgugcccggcgacagagccgccccccugggcuaccccgacuacagcggccagcuggagaucgaggugcagaccgagaccaccaagaccggcgacaagcugaaggugaccaccuucgacaugauccugggccccaccaccaacguggaccaggugcccuaccagggcaagguguacgccagccugaccaccgccagcagccuggaccugguggacggcagagccagagccgugcccagaagcguguacagcuuccaggacgugcugcccgaguacaacgacggccugcuggugccccuggcccccccccugggccccuaccugcccggcgaggugcugcugagauucagaaccuacaugagacagcuggacaccgccgacgccgccgcccagcccaucgacugcgcccugccccaggaguucaucagcugguucgccagcaacaacuucaccgugcagagcgacgcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggugaccggcagaacccugaagcaguga

SEQ ID NO: 24350 - RNA, 1623 nt, Artificial Sequence
  derived and/or modified sequence opt4 from major_viral_capsid_protein__Norovirus__AFN09918
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagcagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcgccggcagaagaagagcccuguga

SEQ ID NO: 24351 - RNA, 1623 nt, Artificial Sequence; identical to SEQ ID NO: 22522
  derived and/or modified sequence opt4 from major_viral_capsid_protein__Norovirus__AFN09921

SEQ ID NO: 24352 - RNA, 1623 nt, Artificial Sequence
  derived and/or modified sequence opt4 from major_viral_capsid_protein__Norovirus__AFN09924
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcaacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24353 - RNA, 1623 nt, Artificial Sequence; identical to SEQ ID NO: 22522
  derived and/or modified sequence opt4 from major_viral_capsid_protein__Norovirus__AFN09927

SEQ ID NO: 24354 - RNA, 1623 nt, Artificial Sequence
  derived and/or modified sequence opt4 from major_viral_capsid_protein__Norovirus__AFN09930
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaucaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24355 - RNA, 1623 nt, Artificial Sequence; identical to SEQ ID NO: 22522
  derived and/or modified sequence opt4 from major_viral_capsid_protein__Norovirus__AFN09933

SEQ ID NO: 24356 - RNA, 1623 nt, Artificial Sequence; identical to SEQ ID NO: 22522
  derived and/or modified sequence opt4 from major_viral_capsid_protein__Norovirus__AFN09936

SEQ ID NO: 24357 - RNA, 1623 nt, Artificial Sequence
  derived and/or modified sequence opt4 from major_viral_capsid_protein__Norovirus__AFN09939
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24358 - RNA, 1623 nt, Artificial Sequence; identical to SEQ ID NO: 22522
  derived and/or modified sequence opt4 from major_viral_capsid_protein__Norovirus__AFN09942

SEQ ID NO: 24359 - RNA, 1623 nt, Artificial Sequence
  derived and/or modified sequence opt4 from major_viral_capsid_protein__Norovirus__AFN09945
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24360 - RNA, 1623 nt, Artificial Sequence
  derived and/or modified sequence opt4 from major_viral_capsid_protein__Norovirus__AFN09948
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24361 - RNA, 1623 nt, Artificial Sequence; identical to SEQ ID NO: 22522
  derived and/or modified sequence opt4 from major_viral_capsid_protein__Norovirus__AFN09951

SEQ ID NO: 24362 - RNA, 1623 nt, Artificial Sequence
  derived and/or modified sequence opt4 from major_viral_capsid_protein__Norovirus__AFN09954
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgaccugaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24363 - RNA, 1623 nt, Artificial Sequence
  derived and/or modified sequence opt4 from major_viral_capsid_protein__Norovirus__AFN09957
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24364 - RNA, 1623 nt, Artificial Sequence
  derived and/or modified sequence opt4 from major_viral_capsid_protein__Norovirus__AFN09960
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucagaggcagaagcagcgcccugguggugcacccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgaguacaagcugcacaagagcgacuacgugaccguggcccacaccggccagcacgaccuggugaucccccccaacggcuacuucagauucgacagcugggugaaccaguucuacacccuggccgccaugggcaacggcaccggcagaagaagagcccuguga

SEQ ID NO: 24365 - RNA, 1623 nt, Artificial Sequence
  derived and/or modified sequence opt4 from major_viral_capsid_protein__Norovirus__AFN09963
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccagcuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24366 - RNA, 1623 nt, Artificial Sequence; identical to SEQ ID NO: 22522
  derived and/or modified sequence opt4 from major_viral_capsid_protein__Norovirus__AFN09966

SEQ ID NO: 24367 - RNA, 1623 nt, Artificial Sequence; identical to SEQ ID NO: 23336
  derived and/or modified sequence opt4 from major_viral_capsid_protein__Norovirus__AFN09969

SEQ ID NO: 24368 - RNA, 1623 nt, Artificial Sequence
  derived and/or modified sequence opt4 from major_viral_capsid_protein__Norovirus__AFN09972
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24369 - RNA, 1593 nt, Artificial Sequence
  derived and/or modified sequence opt4 from major_viral_capsid_protein__Norovirus__AFN09975
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccagauucgagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacggccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24370 - RNA, 1623 nt, Artificial Sequence
  derived and/or modified sequence opt4 from major_viral_capsid_protein__Norovirus__AFN09978
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccugcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24371 - RNA, 1623 nt, Artificial Sequence
  derived and/or modified sequence opt4 from major_viral_capsid_protein__Norovirus__AFN09981
augaagauggccagcaacgacgugaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24372 - RNA, 1623 nt, Artificial Sequence
  derived and/or modified sequence opt4 from major_viral_capsid_protein__Norovirus__AFN09984
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugauguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24373 - RNA, 1623 nt, Artificial Sequence; identical to SEQ ID NO: 22112
  derived and/or modified sequence opt4 from major_viral_capsid_protein__Norovirus__AFN09987

SEQ ID NO: 24374 - RNA, 1623 nt, Artificial Sequence; identical to SEQ ID NO: 22112
  derived and/or modified sequence opt4 from major_viral_capsid_protein__Norovirus__AFN09990

SEQ ID NO: 24375 - RNA, 1623 nt, Artificial Sequence
  derived and/or modified sequence opt4 from major_viral_capsid_protein__Norovirus__AFN09993
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacgacagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacagcgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24376 - RNA, 1623 nt, Artificial Sequence; identical to SEQ ID NO: 22112
  derived and/or modified sequence opt4 from major_viral_capsid_protein__Norovirus__AFN09996

SEQ ID NO: 24377 - RNA, 1623 nt, Artificial Sequence; identical to SEQ ID NO: 23336
  derived and/or modified sequence opt4 from major_viral_capsid_protein__Norovirus__AFN09999

SEQ ID NO: 24378 - RNA, 1623 nt, Artificial Sequence
  derived and/or modified sequence opt4 from major_viral_capsid_protein__Norovirus__AGC96529
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacauccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24379 - RNA, 1623 nt, Artificial Sequence
  derived and/or modified sequence opt4 from major_viral_capsid_protein__Norovirus__AGC96532
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagacccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24380 - RNA, 1644 nt, Artificial Sequence
  derived and/or modified sequence opt4 from major_viral_capsid_protein__Norovirus__AGC96535
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcgugggcgccaccagagcccacgaggugcacaucgacaccaccaaccccagauacacccccaagcugggcagcgugcugaugcacagcgagagcagcgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24381 - RNA, 1623 nt, Artificial Sequence
  derived and/or modified sequence opt4 from major_viral_capsid_protein__Norovirus__AGS16690
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccaacuacagcggcagcgacgugcccaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24382 - RNA, 1623 nt, Artificial Sequence; identical to SEQ ID NO: 24381
  derived and/or modified sequence opt4 from major_viral_capsid_protein__Norovirus__AGS16693

SEQ ID NO: 24383 - RNA, 1623 nt, Artificial Sequence; identical to SEQ ID NO: 23050
  derived and/or modified sequence opt4 from major_viral_capsid_protein__Norovirus__ALM98919

SEQ ID NO: 24384 - RNA, 1623 nt, Artificial Sequence; identical to SEQ ID NO: 23050
  derived and/or modified sequence opt4 from major_viral_capsid_protein__Norovirus__ALM98922

SEQ ID NO: 24385 - RNA, 1623 nt, Artificial Sequence; identical to SEQ ID NO: 23050
  derived and/or modified sequence opt4 from major_viral_capsid_protein__Norovirus__ALM98928

SEQ ID NO: 24386 - RNA, 1623 nt, Artificial Sequence; identical to SEQ ID NO: 23050
  derived and/or modified sequence opt4 from major_viral_capsid_protein__Norovirus__ALM98931

SEQ ID NO: 24387 - RNA, 1623 nt, Artificial Sequence; identical to SEQ ID NO: 22409
  derived and/or modified sequence opt4 from major_viral_capsid_protein__Norovirus__ALM98934

SEQ ID NO: 24388 - RNA, 1623 nt, Artificial Sequence
  derived and/or modified sequence opt4 from major_viral_capsid_protein__Norovirus__ALM98940
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24389 - RNA, 1623 nt, Artificial Sequence; identical to SEQ ID NO: 23050
  derived and/or modified sequence opt4 from major_viral_capsid_protein__Norovirus__ALM98943

SEQ ID NO: 24390 - RNA, 1623 nt, Artificial Sequence
  derived and/or modified sequence opt4 from putative_capsid_protein__Norovirus__ABD73936
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacgugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagcccuguga

SEQ ID NO: 24391 - RNA, 1560 nt, Artificial Sequence
  derived and/or modified sequence opt4 from structural_capsid_protein__Norovirus__ABY67257
augaagaugaccgacaaggacacccaggaggccgcccccgcccugggccaggugcugccccccgagguggagguggccauccccguggagcccaccgccggcgcccagaucgccgcccccaccgccggccaggugaaccccaucgaccccuggaucuucgccaacuucgugcaggccccccagggcgaguucaccaucagccccaacaacaaccccggcgaggugcuguucgagcuggagcugggccccgagcugaaccccuaccuggcccaccugagacagauguacaacggcuggaccggcagcaucagagugaaggugauccuggccggcaacgccuucagcgccggcaagaucaucguguucugcaucccccccggcuucgacgccagcuaccugacccccuuccaggccacccaguucccccacgugaucauggacgugagagccgccgagcccaucgagaucccccuggccgacgugagaaacgugcuguuccaccagggccccgacagcagaaugagacugaugggcaugcuguacaccccccugagagccaacagcggcgccgaccccuucguggugaccggcagagugcugaccugccccagccccgacuucagcuucuucuuccuggugccccccaccguggaggagagaagcacccccuucagcgugcccaacgugcccguguacagccugaccaacagcagagcccccgugcccaucuacgagcugagaagcagcagaagccugccccugaccgugcaguuccagaacggcagaugcaccguggagggcgaccugcugggcaccacccccuucagcgccggcgaccugugcagcuucaugugcaucagaggcgacacccagcacaucgccgagcugcuggagcccgacgagagcgccuucguggugggcgagagacccgccacccugggcuuccccgacuucagccagugcgugcugcaccugcugcuggccgacggcaccggcaucuggcaccagagccuggacgugaagaacccccagcacuucacccccgccaucggccagguggugcugagcggcgacgugccccugaccagaaccagagugagacuggacuacgugcugagcaccagcagagacagcuucugggugcugcccgacuacagaagcgacgugcugggcagcgaguucgcccccgccgugagcgcccccggcgugggcgagacccugcuguucuucaugggcagagcccccgugcagggccccagcaacccccugcccugccugcugccccuggaguggguguuccacuucgccagcgagagacccaccaagcagagcgacguggcccugcugaacuacgugaaccccgacaccggcagagugcuguucgaggccaagcuguacagcagcggcuuccugaccgugaaccugggcaccgccaacgagguggugcugcccaccagcggcaucuucaaguucgccagcugggugagccuguacuaccagcugagacccgugggcacccugagcgccggcagaagacugcccagaguggacggcuacuga

SEQ ID NO: 24392 - RNA, 1653 nt, Artificial Sequence
  derived and/or modified sequence opt4 from viral_capsid_protein__Norovirus__AHA91656
augaugauggccagcaaggacgccaccagcaacauggacggcaccagcggcgccggccagcuggugcccgagaacaacaacaccagcgagcccaucaacauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccuggcccaccugagccagauguacaacggcugggugggcaacaugaaggugagaguggugcuggccggcaacgccuucagcgccggcaagaucaucgugugcugcaucccccccggcuucagcgcccccaacaucagcaucgcccaggccaccauguucccccacgugaucgccgacgugagagugcuggagcccaucgacaucccccuggacgacgugagaaacgugcuguuccacaacaacgacaacggcaaccagaccaugagacugcugugcaugcuguacaccccccugagaagcggcggcaccagcagcggcaccgaccccuucgugaucgccggcagagugcugaccugccccacccccgacuucaacuuccuguuccuggugccccccaccguggagcagaagaccaagcaguucagcgugcccaaccugccccugaacgugaugagcaacagcagagugcccagccugcugaacgccaugguggugagccccgaccaggcccagguggugcaguuccagaacggcagaugcacccuggacggccagaugcugggcaccaccaccgugagcgccagcugcguggccagauucagaggcaagaccuuccaggcccccgacaacagacugggcaucaaccuggccgagaucagcggcgagcccuaccacgccuucgagagccccgccccccugggcuuccccgacuucggcgacggcgacuggcacgugaccgccaccaaggugacccccagccagcuggaggccaacgaccccguggugaugggcaacgugcagcccuacaacccccaguucgccccccaccugggcacccuggugguggagaaccccacccccgacaacgugaccaccggcaccgaccugcuguucaacaucaccuggcugagcaacagagccaacaacagauucaaccccugggugauccccaacuacggcagcacccugaccgaggccgcccagcuggcccccagcaucuucccccccggcuucggcgagaccaucguguacuucaacagcaccuuccccgccgugggcgccaccacccacgccgccauccccugccugcugccccaggaguucguggcccacuucgugaacgagcaggcccccaucagaggcgaggccgcccugcugcacuacaucgaccccgacacccacagaaaccugggcgaguucaagaucuaccccgagggcuucgugaccugcgugcccaacgugggcggcaccggcccccagagccugcccaccaacggcaucuucguguucgugagcugggugagcagauacuaccagcugaagcccgugggcaccgccggccaggccagaagacugggcuucagaagaguguga

SEQ ID NO: 24393 - RNA, 1629 nt, Artificial Sequence; identical to SEQ ID NO: 22457
  derived and/or modified sequence opt4 from VP1_capsid_protein__Norovirus__BAL60747

SEQ ID NO: 24394 - RNA, 1629 nt, Artificial Sequence; identical to SEQ ID NO: 22458
  derived and/or modified sequence opt4 from VP1_capsid_protein__Norovirus__BAL60751

SEQ ID NO: 24395 - RNA, 1629 nt, Artificial Sequence; identical to SEQ ID NO: 22465
  derived and/or modified sequence opt4 from VP1_capsid_protein__Norovirus__BAL60763

SEQ ID NO: 24396 - RNA, 1629 nt, Artificial Sequence; identical to SEQ ID NO: 22468
  derived and/or modified sequence opt4 from VP1_capsid_protein__Norovirus__BAL60765

SEQ ID NO: 24397 - RNA, 1629 nt, Artificial Sequence; identical to SEQ ID NO: 22479
  derived and/or modified sequence opt4 from VP1_capsid_protein__Norovirus__BAL60787

SEQ ID NO: 24398 - RNA, 1629 nt, Artificial Sequence; identical to SEQ ID NO: 22480
  derived and/or modified sequence opt4 from VP1_capsid_protein__Norovirus__BAL60789

SEQ ID NO: 24399 - RNA, 1629 nt, Artificial Sequence; identical to SEQ ID NO: 22491
  derived and/or modified sequence opt4 from VP1_capsid_protein__Norovirus__BAL60807

SEQ ID NO: 24400 - RNA, 390 nt, Artificial Sequence
  derived and/or modified sequence opt4 from capsid__Norovirus__ACL14997
auggccagcaacgacgccgcccccagcaacgacggcgccgccggccuggugcccgagagcaacaacgaggugauggcccuggagcccguggccggcgccagccuggccgcccccgugaccggccagaccaacaucaucgaccccuggaucagaaugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcauggaggugcagaucaugcuggccggcaacgccuucaccgccggcaagcugaucuucgccgccgugccccccuacaacagaagaugcuga

SEQ ID NO: 24401 - RNA, 561 nt, Artificial Sequence
  derived and/or modified sequence opt4 from truncated_capsid_protein__Norovirus__ACB56490
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugaugcagcuggagcccgugcugaucccccugcccgacgugagaaacaacuucuaccacuacaaccagagcaacgacagcaccaucaaguucgacagcaacgccguguacaccaccuga

SEQ ID NO: 24402 - RNA, 627 nt, Artificial Sequence
  derived and/or modified sequence opt4 from truncated_capsid_protein__Norovirus__ACF77106
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccaucagcuga

SEQ ID NO: 24403 - RNA, 627 nt, Artificial Sequence
  derived and/or modified sequence opt4 from truncated_capsid_protein__Norovirus__ACF77107
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccuga

SEQ ID NO: 24404 - RNA, 66 nt, Artificial Sequence
  derived and/or modified sequence opt4 from truncated_capsid_protein__Norovirus__ACU28807
augaagauggccagcaacgacgcccaccccagcgacggcagcgccgccaccagcagccagagauga

SEQ ID NO: 24405 - RNA, 312 nt, Artificial Sequence
  derived and/or modified sequence opt4 from truncated_capsid_protein__Norovirus__ACU28808
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggccuguga

SEQ ID NO: 24406 - RNA, 123 nt, Artificial Sequence
  derived and/or modified sequence opt4 from truncated_capsid_protein__Norovirus__ACV03476
augaagauggccagcaugacccccacccaccugaugggcccccagcccaccagcagccagagaagcaccaugagacuguggcuguggagcccccugagcgugccccugcugagaagacuguga

SEQ ID NO: 24407 - RNA, 87 nt, Artificial Sequence
  derived and/or modified sequence opt4 from truncated_capsid_protein__Norovirus__ACV03479
augaagauggccagcaugaccccccugcaccugaugauggugccccccgccagcagccagagaagcaccaugagacaguggagauga

SEQ ID NO: 24408 - RNA, 1623 nt, Artificial Sequence
  derived and/or modified sequence opt4 from capsid_protein__Norovirus__AFN70960.1
augaagauggccagcaaggacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggccccccugggcaacggcaccggcagaagaagagcccuguga

SEQ ID NO: 24409 - RNA, 1629 nt, Artificial Sequence
  derived and/or modified sequence opt4 from VP1__Norovirus_and/or_Norovirus-like__X81879
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagaagaucaccauguucccccacgugaucaucgacgugagaacccuggagcccgugcugcugccccugcccgacgugagaaacagcuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugcccaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccugaacaacgugaccaucaccaaccugaacggcagccccuucgaccccagcgaggacauccccgccccccugggcgugcccgacuuccagggcagaguguucggcgugaucagccagagagacaagcagaacgccgccggccacagcgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagccaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24410 - RNA, 1728 nt, Artificial Sequence
  derived and/or modified sequence opt4 from VP1__Norovirus_and/or_Norovirus-like__FJ875027
augaagauggccagcaacgacgccgccccccccagcagcgacggcgccgccaaccuggugcccgagaucaacaacgaggugauggcccuggagcccguggccggcgcccagcuggccgcccccguggccggccaguucaacgccaucgaccccuggaucagacagaacuucgugcaggcccccgagggcgaguucaccgugagccccagaaacgcccccggcgagauccugcugaaccuggagcugggcccccaccugaaccccuuccugcagcaccuggcccagauguacaacgccuacgccggcggcauggaggugcagguggugcuggccggcaacgccuucaccgccggcaagaucaucuucgccgccauccccccccacuucccccccgagagacugagcgccgcccaggccacccaguucccccacgugaucguggacgugagacagcuggagcccaucgugcugccccugcccgacgugagacacaaccuguuccacuucaaccagcagaacgacgagagaaugcaccugguggccuuccuguacaccccccugagagccaacagcggcaacggcgacgacguguucaccgugagcugcagagugcugaccagacccagccaggacuucgaguucauguuccuggugccccccaccguggagaagaagaccguggccuucagccugccccagcuggccgugggcgagaugagcaacagcagauggcccgccagaaucaccggcauggugguggaccccagacugccccaggugcugcacauccagaacggcagaugcacccuggacggcacccugaugggcaccacccagcugaaccccaacgacaucugcagaaucagaggcuacuucagcagcagcagacccgagcugcugugcgagggcgaggagagcgaggugaacaccacccccaccgacagcggcgccaccggcgaccagacccccgaggugagaaccggcaccagagccacccagagaugguucgccgugaccgagcugaacggccagguguacgaccccuucggcgaccagcccgccccccugggcgugcccgacuucaaggccagaauccugggcgcccugaugagacugcccggcaccaaccccaccagcaacagcagauucgaggacgccuggguggagaccaacaaccagaccaccuacgcccccgccaccggcgugguggccaucaccaccaacgacaacagcagcggcaacuacgccaacgaccagaccugcgaguucgugccccugggcaucgagaucaccgacagcgcccccuacaacgaguucgaccugcccagcuacggcggcgccgccagcagcggcaacagaaaccuggcccccaccguggcccccaccuuccccggcgaggccauccugcuguucggcagcaacaugcccguguacaacagaagcagcggcaccgacaacaaggacaucagaugccugcugcccaacgaguacgugcagcaccuguacgacacccaggcccccagccugagcgacguggcccuggugagauacgugaacagagacaccggcagagugcuguucgaggccaagcugcacagagacggcuucaugaccgugaacgccagcagcaccaccgugcugcccguggacggcuacuucagauucgacagcugggugaaccaguucuacgcccugagccccgugggcaacgccagcggcagaagauga

SEQ ID NO: 24411 - RNA, 1725 nt, Artificial Sequence
  derived and/or modified sequence opt4 from VP1__Norovirus_and/or_Norovirus-like__JF939046
augaagauggccagcaacgacgccgccagccccagcagcgacggcgccgccaaccuggugcccgagaucaacaacgaggugauggcccuggagcccguggccggcgcccagcuggccgcccccguggccggccaguucaacgccaucgaccccuggaucagacagaacuucgugcaggcccccgagggcgaguucaccgugagccccagaaacgcccccggcgagauccugcugaaccuggagcugggcccccaccugaaccccuuccugcagcaccuggcccagauguacaacgccuacgccggcggcauggaggugcagguggugcuggccggcaacgccuucaccgccggcaagaucaucuucgccgccgugcccccccacuucccccccgagagacugagcgccgcccaggccacccaguucccccacgugaucguggacgugagacagcuggagcccaucauccugccccugcccgacgugagacacaaccuguuccacuucaaccagcagaacgacgagagaaugcaccugguggccuuccuguacaccccccugagagccaacagcggcagcggcgacgacguguucaccgugagcugcagagugcugaccagacccagccaggacuucgaguucauguuccuggugccccccaccguggagaagaagaccguggccuucagccugccccagcuggccaucggcgagaugagcaacagcagauggcccgccagaaucaccggccuggugguggaccccagacugccccaggugcugcacauccagaacggcagaugcacccuggacggcacccugaugggcaccacccagcugaaccccaacgacaucugcagaaucagaggcuacuucagcagcagcagacccgagcugcugugcgagaacgaggagagcgccaccgaccccaugcccaccgagaccgacaccgacaaccagccccccgaggugagagcccaggccagagccacccagagaugguucgccgugaccgagcugaacggccagguguacgaccccuucggcgaccagcccgccccccugggcgugcccgacuucaaggccagaauccugggcgcccugaugagacugcccggcaccaaccccaccagcaacagcagauucgaggacgccuggguggagaccaacaaccagaccaccuacgcccccgccgccggcgugguggccaucaccaccaacgacaacagcagcagcaacuacgccaacgaccagaccugcgaguucgugccccugggcaucgagaucaccgacagcgcccccuaccacgaguucgaccugcccagcuacggcggcgccgccagcagcggcaacagaaaccuggcccccaccguggcccccaccuuccccggcgaggccauccugcuguucggcagcaacaugcccguguacaacagaaacaccggcaccagcaacaaggacaucagaugccugcugcccaacgaguacgugcagcaccuguacgacacccaggcccccagccugagcgacguggcccuggugagauacgugaacagagacaccggcagagugcuguucgaggccaagcugcacagagacggcuucaugaccgugaacgccagcagcaccaccgugcugcccguggacggcuacuucagauucgacagcugggugaaccaguucuacgcccugagccccgugggcaacgccagcggcagaagauga

SEQ ID NO: 24412 - RNA, 1722 nt, Artificial Sequence
  derived and/or modified sequence opt4 from VP1__Norovirus_and/or_Norovirus-like__JF930689
augaagauggccagcaacgacgccaccgcccccagccaggacggcgccgccaaccuggugcccgagagccagcacgaggugcuggcccuggagcccguggccggcgccgcccuggccgcccccguggccggccaguucaacgccaucgaccccuggaucaagcagaacuucgugcaggcccccgccggcgaguucaccgugagccccagaaacgcccccggcgagauccugauggaccuggagcugggccccgagcugaaccccuuccuggcccaccuggcccagauguacaacgccuacgccggcggcauggaggugcagaucauccuggccggcaacgccuucaccgccggcaagaucaucgugugcgccgugccccccaacuucccccccgacagacugagcgccagccaggccaccaacuucccccacgugaucauggacgugagaacccuggagcccgugauccugccccugcccgacgugagagccggcuucuuccacuacaaccagcugagagagcccagaaugagacugauggcccugcuguacaccccccugagagccaacggcaccggcgacgacgccuucaccgugagcugcagagugcugaccagacccaugcaggacuucgaguucauguuccuggugccccccaccguggagagcagagugacccccuucagcgugcccaccuaccccgugguggagaugaccaacagcagauggcccgccagaaucagcggcaugcacgugaacgccaaccagacccuggccgugcaguuccagaacggcagaugcacccuggacggccagcugaugggcaccacccagcugugcgccgccgacgugugcagaaugagaggcagauacaccagcaccagagccgaccuggccggcguggaccacaccgaccagggccccagccugggcaccggccccagcgacgacagcgugagcgugcccgaggccagagcccagaccagaaccggcgugagcgcccaccugcagcuggaggagcugaacggccagcccuacgagguguacggcgagcagcccgccccccugggcacccccgacuucagaugcagacugaugggcgagcuggugagacugcccagcaccagccccgccgcccagagcagauucagagacgccuucuucgacaccuacggcgcccuguucgcccccgccgugggcagcaccaccuucaccgugaacaacagcagcaccagcgacuucgccaacggccagcccuucgaguuccugcccaucggcguggagaucggcaacagcgcccaguacgacgaguucgcccugcccagcuacaacggcgccaucggcgagaacagacaccuggcccccguggccgcccccggcuuccccggcgagaacaucguguucuucagcagcaaccugcccgugugggacagcaccagcgcccagaacaacagaagaaucagcugccugcugcccaacgaguucgugcagcacuucuacgaccugcaggcccccagccagagcgacguggcccugcugagauacgugcaccccgagagcggcagagugcuguucgagugcaagcuguacagagacggcuuccugaccgugaacggcgccagccuggccgaguuccccgugaacggcuacuucagauucgacagcugggugaaccaguucuucacccugagccccgugggcaccggcagcggcagaagauga

SEQ ID NO: 24413 - RNA, 1719 nt, Artificial Sequence
  derived and/or modified sequence opt4 from VP1__Norovirus_and/or_Norovirus-like__GQ443611
augaagauggccagcaacgacgccaccgcccccagccaggacggcgccgccaaccuggugcccgagagccagcacgaggugcuggcccuggagcccguggccggcgccgcccuggccgcccccguggccggccaguucaacgccaucgaccccuggaucaagcagaacuucgugcaggcccccgccggcgaguucaccgugagccccagaaacgcccccggcgagauccugauggaccuggagcugggccccgagcugagccccuuccuggcccaccuggcccagauguacaacgccuacgccggcggcauggaggugcagaucauccuggccggcaacgccuucaccgccggcaagaucaucgugugcgccgugccccccaacuucccccccgacagacugagcgccagccaggccaccaacuucccccacgugaucauggacgugagaacccuggagcccgugauccugccccugcccgacgugagagccggcuucuuccacuacaaccagcugagagagcccagaaugagacugauggcccugcuguacaccccccugagagccaacggcaccggcgacgacgccuucaccgugagcugcagagugcugaccagacccaugcaggacuucgaguucauguuccuggugccccccaccguggagagcagagugacccccuucagcgugcccaccuaccccgugguggagaugaccaacagcagauggcccgccagaaucagcggcaugcacgugaacgccaaccagacccuggccgugcaguuccagaacggcagaugcacccuggacggccagcugaugggcaccacccagcugugcgccgccgacgugugcagaaugagaggcagauacaccagcaccagagccgaccuggccggcguggaccacaccgaccagggccccagccugggcgccggccccagcaacgaccccgugagcgugcccgaggccagaagccagaccagaaccagcgugagcgcccaccugcagcuggaggagcugaacggccagcccuacgagguguacggcgagcagcccgccccccugggcacccccgacuucugcugcagacugaugggcgagcuggugagacugcccagcaccagccccgccgcccagagcagauucagagacgccuucuucgacaccuacggcgcccuguucgcccccgccgugggcagcaccaccuucaccgugaacaacagcagcaccagcgacuucgccaacggccagcccuucgaguuccugcccaucggcguggagaucggcaacagcgcccaguacgacgaguucgcccugcccagcuacaacggcgccaucggcgagaacagacaccuggcccccguggccgcccccggcuuccccggcgagaacaucguguucuucagcagcaaccugcccgugugggacagcaccagcgcccagaacaacagaagaaucagcugccugcugcccaacgaguucgugcagcacuucuacgaccugcaggcccccagccagagcgacguggcccugcugagauacgugcaccccgagagcggcagagugcuguucgagugcaagcuguacagagacggcuuccugaccgugaacggcgccagccuggccgaguuccccgugaacggcuacuucagauucgacagcugggugaaccaguucuucacccugagccccgugggcaccggcagcggcagauga

SEQ ID NO: 24414 - RNA, 1719 nt, Artificial Sequence
  derived and/or modified sequence opt4 from VP1__Norovirus_and/or_Norovirus-like__EU224456
augaagauggccagcaacgacgccgcccccagcagcgacggcgccggcaaccuggugcccgagagccaccaggaggugcugccccuggcccccguggccggcgccgccaucgccgcccccguggugggccagcagaacaucaucgaccccuggaucaaggagaacuucgugcaggccccccagggcgaguucaccgugagccccaagaacagccccggcgaggugcuggugaaccuggagcugagccccaagcugaaccccuaccuggaccaccugagcaagauguacaacgccuacgccggcggcauggagaucgagaucauccuggccggcaacgccuucaccgccggcaaggugcugaucgccgccgugccccccaacuuccccguggagaacaucagcgugagccaggccagccaguucccccacgugaucguggacgugagaacccuggagcccaucagacugccccugcccgacgugagaaccaacuucuuccacuacaccaccagagacgagcccaagaugagaaucguggccuggcuguacaccccccugagaaccaacggcagcggcgacgacagcuucaccgugagcggcagaauccugaccagacccagcgccgacuucgaguucagcuuccuggugccccccaccguggagaccaagaccgugagcuucagcgugcccggccugaccguggaggagaugagcaacagcagauggcccgcccagaucaacggccugguggugagaggcaacgaggcccagguggugcacuuccagaacggcagaugcaccaccgagggcaugcugcugggcaccaccacccugaacgugaacagcaucugcggccugagaggcaccagcaucagccacgccagcgugagagaggcccccgcccugagcgaggagaugcccccccuggaggacgagguggcccacggcgccgccgccaccuacgccgugggcagagccgccgacaccacccuguggaucagaguggaggagcccaacggccagcccuacgacaucuucggcgagcagcccgccccccugggcacccccgacuucaccgccgugaucaucggcaccgccaucagacccagaaccgccagcggcgccuaccugcacgacgccuacguggacaccagacccggcgacgccgacuucacccccagcaccggcaacaccaagaucgugcugagaggcggcggcagcggccacgugggcgagggccacuacuggcaguucaagcccaucgccguggagggcggccccaacagacccguguaccaggaguacaaccugcccgaguacgccggccccaccgccagcaaccacaaccuggccccccccguggcccccaagaugcccggcgagcugcugcugcuguucgagagcgacaugcccgugugggacaacggcagcggcagcgcccccacccagaagauccacugccugcugcccaacgacuucgugacccacuucuucgaccugcaggcccccgcccuggccgaggccgcccugcugagauacgugcaccccgacagcggcagaacccuguucgagugcaagcuguacagagagggcuacaugguggugguggcccccagcggcagacuggacuucccccuggacggcuacuucagauucgacagcugggugaacgccuucuacgugcugagccccgugggcaacggccagggcagaagauga

SEQ ID NO: 24415 - RNA, 1719 nt, Artificial Sequence
  derived and/or modified sequence opt4 from VP1__Norovirus_and/or_Norovirus-like__EF450827
augaagauggccagcagcgacgccacccccagcagcgacggcgccggcaaccuggugcccgagagccagcaggaggugcugccccuggcccccguggccggcgccgcccuggccgcccccguggugggccagcagaacaucaucgaccccuggaucaaggagaacuucgugcaggccccccagggcgaguucaccgugagccccaagaacagccccggcgaggugcuggugaaccuggagcugagccccagacugaaccccuaccugcaccaccugagcaagauguacaacgccuacgccggcggcauggagguggagaucauccuggccggcaacgccuucaccgccggcaaggugcugaucgccgccgugccccccaacuuccccaucgagaacgugagcgccagccaggccagccaguucccccacgugaucguggacgugagaacccuggagcccaucagacugccccugcccgacgugagaaccaacuucuuccacuacaccacccaggaggagcccagaaugagaaucguggccuggcuguacaccccccugagaaccaacggcagcggcgacgacagcuucaccgugagcggcagaauccugaccagacccagccccgacuucgaguucagcuuccuggugccccccaccguggagaccaagaccgugagcuucagcgugcccggccugguggugcaggacaugagcaacagcagauggcccgcccagaucagcggccugguggugagaggcaacgaggcccagguggugcacuuccagaacggcagaugcaccaccgagggcaugcugcugggcaccaccacccugaacaucaacagcaucugcggccugagaggccugagcgugagccaggccagcgugagaggcgcccccgcccugaccgaggagaugcccccccuggaggacgagguggccgacggcgccgccgccaccuacacccugaccagagccgccgacaccgcccuguggcugagaguggaggagcccgacggcagacccuacgacaucuucggcgaccagcccgccccccugggcacccccgacuucaccgccgugaucgugggcaccgccaucagacccagaaccaccagcggcgccuaccugcacgacgccuacguggacaccacccccggcgacgccgacuucacccccagcaccggcaacaccaagaucgugcugagaggcggcggcagcggccacgugggccagggccacuacuggcaguucaagcccaucgccguggagggcggcggcagcagaccccaguaccaggaguacaaccugcccgacuacgccggccccaccgccagcaaccacgaccuggccccccccguggcccccagaaugcccggcgagcugcugcugcuguucgagagcgacaugcccgugugggacaacggcgccggcgccgcccccgcccagaagauccacugccugcugcccaacgaguucaucacccaccuguucgaccugcaggcccccgcccuggccgaggccgcccugcugagauacgugcaccccgacagcggcagaacccuguucgagugcaagcuguacagagagggcuacauggugguggccgcccccgugggcagacugaacuucccccuggacggcuacuucagauucgacagcugggugagcgccuucuacgugcugagccccgugggcagcggccagggcagaagauga

SEQ ID NO: 24416 - RNA, 1719 nt, Artificial Sequence
  derived and/or modified sequence opt4 from VP1__Norovirus_and/or_Norovirus-like__JF781268
augaagauggccagcagcgacgccacccccagcagcgacggcgccggcaaccuggugcccgagagccagcaggaggugcugccccuggcccccguggccggcgccgcccuggccgcccccguggugggccagcagaacaucaucgaccccuggaucaaggagaacuucgugcaggccccccagggcgaguucaccgugagccccaagaacagccccggcgaggugcuggugaaccuggagcugagccccagacugaaccccuaccuggaccaccugagcaagauguacaacgccuacgccggcggcauggagguggagaucauccuggccggcaacgccuucaccgccggcaaggugcugaucgccgccgugccccccaacuuccccaucgagaacaucagcgccagccaggccagccaguucccccacgugaucguggacgugagaacccuggagcccaucagacugccccugcccgacgugagaaccaacuucuuccacuacaccacccaggaggagcccagaaugagaaucguggccuggcuguacaccccccugagaaccaacggcagcggcgacgacagcuucaccgugagcggcagaauccugaccagacccagccccgacuucgaguucagcuuccuggugccccccaccguggagaccaagaccgugagcuucagcgugcccggccuggugguggaggacaugagcaacagcagauggcccgcccagaucaacggccugguggugagaggcaacgaggcccagguggugcacuuccagaacggcagaugcaccaccgagggcacccugcugggcaccaccacccugagcaucaacagcaucugcggccugagaggccugagcgugagccaggccagcgugagaggcgcccccgcccugaccgaggagaugcccccccuggaggacgagguggccgacggcgccgccgccaccuacacccuggccagagccgccgacaccacccuguggcugagaguggaggagcccgacggcagacccuacgacaucuucggcgaccagcccgccccccugggcacccccgacuucaccgccgugaucgugggcaccgccaucagacccagaaccgccagcggcgccuaccugcacgacgccuacguggacaccacccccggcgacgccgacuucacccccagcaccggcaacaccaagaucgugcugagaggcggcggcagcggccacgugggccagggccacuacuggcaguucagacccaucgccguggagggcggcggcagcagaccccaguaccaggaguacaaccugcccgacuacgccggccccaccgccagcaaccacgaccuggccccccccguggcccccagaaugcccggcgagcugcugcugcuguucgagagcgacaugcccgugugggacaacggcgccggcgccgcccccgcccagaagauccacugccugcugcccaacgaguucaucacccaccuguucgaccugcaggcccccgcccuggccgaggccgcccugcugagauacgugcaccccgacagcggcagaacccuguucgagugcaagcuguacagagagggcuacauggugguggccgcccccgccggcagacugaacuucccccuggacggcuacuucagauucgacagcugggugagcgccuucuacauccugagccccgugggcagcggccagggcagaagauga

SEQ ID NO: 24417 - RNA, 1698 nt, Artificial Sequence
  derived and/or modified sequence opt4 from VP1__Norovirus_and/or_Norovirus-like__KT245136
augaagauggccagcaacggcgccgccgcccccagccaggacggcgccgccaaccuggugcccgagagccagcaggaggugcuggcccuggagcccguggccggcgccgcccuggccgcccccguggccggccaguucaacgccaucgaccccuggaucaagcagaacuucgugcaggcccccgccggcgaguucaccgugagccccagaaacgcccccggcgaggugcugauggaccuggagcugggccccgagaugaaccccuuccuggcccaccuggcccagauguacaacgccuacgccggcggcauggaggugcagaucauccuggccggcaacgccuucaccgccggcaagaucaucgugugcgccgugccccccaacuucccccccgacagacugagcgccagccaggccaccaacuucccccacgugaucauggacgugagaacccuggagcccguggugcugccccugcccgacgugagagccggcuucuuccacuacaaccagcugagagagcccagaaugagacugaugacccugcuguacaccccccugagagccaacggcaccggcgacgacgccuucaccgugagcugcagagugcugaccagacccaugcuggacuucgaguucauguuccuggugccccccaccguggagagcagagugacccccuucagcgugcccaccuaccccgugguggagaugaccaacagcagauggcccgccagaaucagcggcaugcacgugaacgccaaccagacccuggccgugcaguuccagaacggcagaugcacccuggacggccagcugaugggcaccacccagcugugcgccgccgacgugugcagaaugagaggcagauacaccagcaccagagccgaccccgccggccugggcugggaccuggacgccaccacccugguggacggccccgaggccagagugcaggccagaaucagcgugagcgcccaccugcagcuggaggagcugagcggccagcccuacgagguguacggcgagcagcccgccccccugggcacccccgacuuccagugcagacugaugggcgagcuggugagacugcccagcgccaaccccguggcccagagcagauucagagacgccuucuucgacaccuacggcgcccuguucgcccccgccgugggcagcgugaccgugaccgugaacaacagcagcagcagcgacuucgccaacgaccagcccuucgaguuccugcccaucggcguggagaucggcaacagcgccagauacgacgaguucgcccugcccagcuacaacggcgccaucggcgagaacagacaccuggcccccaucgccgcccccggcuuccccggcgagaaccugaucuucuucagcagcaaccugcccgugugggacagcaccagcgcccagagcaacagaagaaucagcugccugcugcccaacgaguucauccagcacuucuacgaccugcaggcccccagccagagcgacguggcccugcugagauacgugcaccccgagaccgacagauuccuguucgagugcaagcuguacagagacgccuuccugaccgugaacggcgccagcuacgccgaguuccccgugaacggcuacagcagauucgacagcugggugaagcaguucuucacccugagccccgugggcaccggcagcggcagaagauga

SEQ ID NO: 24418 - RNA, 1659 nt, Artificial Sequence
  derived and/or modified sequence opt4 from VP1__Norovirus_and/or_Norovirus-like__AJ844470
augaagauggccagcaaggacgccagccccagcaccgacggcgccgccaaccuggugcccgagagccagcaggaggugcuggcccugcagcccguggccggcgcccagaucgccgcccccguggccggccaguucaacgugaucgaccccuggaucuaccagaacuucgugcaggcccccgagggcgaguucaccgugagccccagaaacagcaccggcgagauccugaugaaccuggagcugggcccccagcugaaccccuaccuggcccaccuggccagaauguacaacgccuacgccggcggcuucgaggugcaggugcugcuggccggcaacgccuucaccgccggcaagaucaucgugugcgccgugccccccaacuucccccugcagaacaucagcgccgcccaggccacccagcugccccacguggugguggacgugagacagcuggagcccguggugcugccccugcccgacgugagagccggcuucuaccacuacaaccagguggaggagagcagaaugagacugguggccauccuguacaccccccugagaaccaacagcgccggcgacgacgccuucaccgugagcugcagaauccugaccagacccgcccccgacuucagcuucuucuuccugaucccccccaccaucgagagcaagaccacccccuucacccugcccagacugcccaucagcgagaugaccaacagcagauucccccuggugaucaagggcauggugguggaccccaaccugccccugcaggccaacuuccagaacggcagaaucacccuggacggcgagcugcagggcaccacccugcccaccagcaccagcaucggcagaaucagcggcaccuacaugagcagcacccccagcagaaucauccagcacgaggacagcggcgacagcacccagcccagaguguucaaccccguguggauggaccugaccgagaacaacuggaccgaguuccagcccuucaacgaccagcccgccccccugggcugccccgacuucaaggccaagauccugggcacccugaucagacagcccaacaacggcagcuacuacuucgacgccuaccuggacaccagacagcacggcaccuucgcccccuacaccggccacgccgccgugcacagcgaccagcaggccggccaccuggcccagggcuacaagauccaguucagccccaccggcaucgagagcgaccagaacaccgaccugaaccagcugcccgacuacggcggcgccaugaccgugagcaagggccuggcccccgccgccgcccccgacuuccccggcgagaugauccuguacuucgugagcgacaugcccgugagaaaccccaacggcgagagaagagacaccgagauccugugccugcugccccaggagauggugacccacuucuacgagcagcaggcccccagccagggcgacguggcccuggugagauacaucaacgccgagaccggcagagugauguucgagggcaagcugcacagaaacggcuucuucaccgugagcgccaccgccagaacccugaucgugcccgacggcuacuucagauucgacagcugggugaacagauucuacacccugagccccaugggcaccggcaacggcagaagaagagccagauga

SEQ ID NO: 24419 - RNA, 1659 nt, Artificial Sequence
  derived and/or modified sequence opt4 from VP1__Norovirus_and/or_Norovirus-like__KJ196291
augaagauggccagcaaggacgccagccccagcaccgacggcaccgccaaccuggugcccgagagccagcaggaggugcuggcccugcagcccguggccggcgcccagaucgccgcccccguggccggccaguucaacgugaucgaccccuggaucuaccagaacuucgugcaggcccccgagggcgaguucaccgugagccccagaaacagcaccggcgagauccugaugaaccuggagcugggcccccagcugaaccccuaccuggcccaccuggccagaauguacaacgccuacgccggcggcuucgaggugcaggugcugcuggccggcaacgccuucaccgccggcaagaucaucgugugcgccgugccccccaacuucccccugcagaacaucagcgccgcccaggccacccagcugccccacguggugguggacgugagacagcuggagcccguggugcugccccugcccgacgugagagccggcuucuaccacuacaaccagguggaggagagcagaaugagacugguggccauccuguacaccccccugagaaccaacagcgccggcgacgacgccuucaccgugagcugcagaauccugaccagacccgcccccgacuucagcuucuucuuccugaucccccccaccaucgagagcaagaccacccccuucacccugcccagacugcccaucagcgagaugaccaacagcagauucccccuggugaucaagggcauggugguggaccccaaccugccccugcaggccaacuuccagaacggcagaaucacccuggacggcgagcugcagggcaccacccugcccaccagcaccagcaucggcagaaucagcggcacccacaugagcagcacccccagcagaaucauccagcacgaggacagcggcgacagcacccagcccagaguguucaaccccguguggauggaccugaccgagaacaacuggaccgaguuccagcccuucaacgaccagcccgccccccugggcugccccgacuucaaggccaagauccugggcacccugaucagacagcccaacaacggcagcuacuacuucgacgccuaccuggacaccagacagcacggcaccuucgcccccuacaccggccacgccgccgugcacagcgaccagcaggccggccaccuggcccagggcuacaagauccaguucagccccaccggcaucgagagcgaccagaacaccgaccugaaccagcugcccgacuacggcggcgccaugaccgugagcaagggccuggcccccgccgccgcccccgacuuccccggcgagaugauccuguacuucgugagcgacaugcccgugagaaaccccaacggcgagagaagagacaccgagauccugugccugcugccccaggagauggugacccacuucuacgagcagcaggcccccagccagggcgacguggcccuggugagauacaucaacgccgagaccggcagagugauguucgagggcaagcugcacagaaacggcuucuucaccgugagcgccaccgccagaacccugaucgugcccgacggcuacuucagauucgacagcugggugaacagauucuacacccugagccccaugggcaccggcaacggcagaagaagagccagauga

SEQ ID NO: 24420 - RNA, 1653 nt, Artificial Sequence
  derived and/or modified sequence opt4 from VP1__Norovirus_and/or_Norovirus-like__KU870455
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaacgccagagccgccgaccugaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagcaccgacuucaccaccaaccagcccaucagauucacccccgugggcaugggcgacaacaacuggagacagugggagcugcccgacuacagcggcagccugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24421 - RNA, 1653 nt, Artificial Sequence
  derived and/or modified sequence opt4 from VP1__Norovirus_and/or_Norovirus-like__AF414408
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugaagcagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccggcagcccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggccagcaggagcagggccacuacgccaccagagcccacgaggcccacaucgacaccaccgaccccaaguacgcccccaagcugggcaccauccugaucaagagcgacagcgacgacuucaacaccaaccagcccaucagauucacccccgugggcaugggcgacaacaacuggagacagugggagcugcccgacuacagcggccaccugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24422 - RNA, 1653 nt, Artificial Sequence
  derived and/or modified sequence opt4 from VP1__Norovirus_and/or_Norovirus-like__AB084071
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcccccaggagcagggccacuacgccaccagagcccacgagacccacaucgacaccaccgaccccaaguacgcccccaagcugggcaccauccugaucaagagcgagagcaacgacuucaucaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24423 - RNA, 1653 nt, Artificial Sequence
  derived and/or modified sequence opt4 from VP1__Norovirus_and/or_Norovirus-like__AF414407
augaagauggccagcaacgacgccgcccccagcaacgacggcgccgccaaccuggugcccgaggccaacaacgaggugauggcccuggagcccguggugggcgccagcaucgccgcccccgccgugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccacccugacccugggcgagcugagcaaccccagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggccagcaggagcagggccacuacgccaccagagcccacgaggcccacaucgacaccaccgaccccaaguacgcccccaagcugggcaccauccugaucaagagcgacagcgacgacuucaacaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24424 - RNA, 1653 nt, Artificial Sequence
  derived and/or modified sequence opt4 from VP1__Norovirus_and/or_Norovirus-like__AB039777
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagccccauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugccccugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccugggcggcacccaguacgaccccaccgacgacauccccgccgugcugggcgccaucgacuucaagggcaccguguucggcguggccagccagagagacgugagcggcccccaggagcagggccacuacgccaccagagcccacgaggcccacaucgacaccaccgaccccaaguacgcccccaagcugggcaccauccugaucaagagcgagagcaacgacuucaccaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24425 - RNA, 1653 nt, Artificial Sequence
  derived and/or modified sequence opt4 from VP1__Norovirus_and/or_Norovirus-like__AB078337
augaagauggccagcaacgacgccgcccccagcaacgacggcgccgccaaccuggugcccgaggccaacgacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggccagcaggagcagggccacuacgccaccagagcccacgaggcccacaucgacaccaccgaccccaaguacgcccccaagcugggcaccauccugaucaagagcggcagcgacgacuucaacaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacugcggcaacaaccccaucguggugccccccaacggcuacuucagauucgaggccuggggcaaccaguucuacacccuggcccccaugggcagcggccagggcagaagaagagcccaguga

SEQ ID NO: 24426 - RNA, 1653 nt, Artificial Sequence
  derived and/or modified sequence opt4 from VP1__Norovirus_and/or_Norovirus-like__AB039776
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagccccauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugccccugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaccgccagagccgccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcccccaggagcagggccacuacgccaccagagcccacgaggcccacaucgacaccaccgaccccaaguacgcccccaagcugggcaccauccugaucaagagcgagagcaacgacuucaccaccaaccagcccaucagauucacccccgugggcaugggcgacaacaacuggagacagugggagcugcccgacuacagcggcagacuggcccugaacaugaaccuggcccccgccgugagccccagcuuccccggcgagagaauccuguucuucagaagcaucgugcccagcgccggcggcuacggcagcggcuacaucgacuaccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagagcccaguga

SEQ ID NO: 24427 - RNA, 1653 nt, Artificial Sequence
  derived and/or modified sequence opt4 from VP1__Norovirus_and/or_Norovirus-like__KT030674
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcgagagacacaccgacauccaguaccaggaguacgagcugcccgacuacagcggccagguggccagcaaccacaaccuggccccccccguggcccccagaaugcccggcgagagccugcugcuguuccagagcaacaugcccgugugggacgacggcagaggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24428 - RNA, 1653 nt, Artificial Sequence
  derived and/or modified sequence opt4 from VP1__Norovirus_and/or_Norovirus-like__DQ093067
augaagauggccagcaacgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacguggugaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcgagggccacaccaacauccaguaccaggaguacgagcugcccgacuacagcggccagguggccagcaaccacaaccuggccccccccguggcccccagaaugcccggcgagagccugcugcuguuccagagcagcaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24429 - RNA, 1653 nt, Artificial Sequence
  derived and/or modified sequence opt4 from VP1__Norovirus_and/or_Norovirus-like__AF195847
augaagauggccagcagcgacgccgcccccagcgccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagccccgaggccgacgagagagccgugggcagcuucgacguguggaucagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcagcggccacaucagcgccaacaaguacugggaguucaagagcuucggcguggagggcgagagacacaccgacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24430 - RNA, 1653 nt, Artificial Sequence
  derived and/or modified sequence opt4 from VP1__Norovirus_and/or_Norovirus-like__JQ970479
augaagauggccagcagcgacgccgcccccagcgccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacguguggaucagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucagaagcuucggcguggagggcgagagacacaccgacgugcaguaccaggaguacgagcugcccgacuacagcggccagguggccagcaaccacaaccuggccccccccguggcccccagaaugcccggcgagagccugcugcuguuccagagcaacaugcccgugugggacgacggcagaggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccgccagcggccugcuggacuucccccuggacggcuucuucagauucgacagcugggugagcagcuucuacauccugagccccgugggcagcggccagggcagaagauga

SEQ ID NO: 24431 - RNA, 1653 nt, Artificial Sequence
  derived and/or modified sequence opt4 from VP1__Norovirus_and/or_Norovirus-like__FM865412
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcgagagacacaccaacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24432 - RNA, 1653 nt, Artificial Sequence
  derived and/or modified sequence opt4 from VP1__Norovirus_and/or_Norovirus-like__AF414426
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcaagagacacaccagcauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24433 - RNA, 1653 nt, Artificial Sequence
  derived and/or modified sequence opt4 from VP1__Norovirus_and/or_Norovirus-like__AF414427
augaagauggccagcagcgacgccgcccccagcgccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcaccgaggccgacgagagagccgugggcagcuucgacguguggaucagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcagcggccacaucagcgccaacaaguacugggaguucaagagcuucggcguggagggcgagagacacaccgacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24434 - RNA, 1653 nt, Artificial Sequence
  derived and/or modified sequence opt4 from VP1__Norovirus_and/or_Norovirus-like__JQ613567
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagggcgugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagcagcgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcgacuacgcccccgccaccggcaacaugagauucaccgugagaaacggcggcaccggccacaucagcgccaacaaguacugggaguucaagagcuucggcguggagggcgagagacacaccgacauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacagacaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24435 - RNA, 1653 nt, Artificial Sequence
  derived and/or modified sequence opt4 from VP1__Norovirus_and/or_Norovirus-like__KC894731
augaagauggccagcagcgacgccgcccccagcaccgacggcgccggcaaccuggugcccgagagccagcaggaggugcugccccuggcccccguggccggcgccgcccuggccgcccccguggugggccagaccaacaucaucgaccccuggaucaaggagaacuucgugcaggccccccagggcgaguucaccgugagccccaagaacagccccggcgagauccuggugaaccuggagcugggccccaagcugaaccccuaccuggaccaccugagcagaauguacaacagcuacgccggcggcaucgacgugaugguggugcuggccggcaacgccuucaccgccggcaaggugcugaucgccgccaucccccccaacuuccccguggagguggugagcgccagccaggccacccaguucccccacgugaucaucgacgugagaacccuggaccccgugagacugccccugcccgacgugagaagcaccuucuuccacuacaccaacgacaccgagcccaagaugagacuggugaucuggcuguacaccccccugagaaccaacggcagcggcgacgacagcuucaccgugagcggcagaauccugaccagacccagccaggacuucgaguucgccuuccugaucccccccaccguggagaccaagaccacccccuucagcgugcccggcuucagcgugcaggagaugagcaacagcagauggcccgccgccaucagcgccaugguggugagaggcaacgagccccagguggugcaguuccagaacggcagagcccaccuggacggcaugcugcugggcaccacccccgugagccccaacuacaucgccagcuacagaggcaucagcaccggcaacagcagaagcgccagccccgaggccgacgagagagccgugggcagcuucgacgugugggugagacugcaggagcccgacggccagcccuacgacaucuucggcaagcagcccgcccccaucggcacccccgacuucaaggccgugaucgugggcuucgccgccagaccccugaccagcggcagcuacgccaacgaggccuacgugaacaccaccgccagcaacuacgcccccgccaccggcaacaugagauucaccgugagaaacggcggcaccggccacaccagcgccaacaaguacugggaguucaagagcuucggcguggagggcgagagacacaccggcauccaguaccaggaguacgagcugcccgacuacagcggccagguggccagcaaccacaaccuggccccccccguggcccccagaaugcccggcgagagccugcugcuguuccagagcaacaugcccgugugggacgacggccacggcgagagcacccccaagaagauccacugccugcugccccaggaguucaucggccacuucuucgacaagcaggcccccagccugggcgacgccgcccugcugagauacgugaaccaggagaccaacagagugcuguucgagugcaagcuguacagagacggcuacaucaccguggccgccagcagcggccugcuggacuucccccuggacggcuucuucagauucgacagcugggugagcagcuucuacauccugagccccgugggcagcggccagggcagaagauga

SEQ ID NO: 24436 - RNA, 1647 nt, Artificial Sequence
  derived and/or modified sequence opt4 from VP1__Norovirus_and/or_Norovirus-like__AF427118
augaagauggccagcaacgacgccgcccccagcagcgacggcgccgccggccuggugcccgagagcaacaacgaggugauggcccuggagcccguggccggcgccagccuggccgcccccgugaccggccagaccaacaucaucgaccccuggaucagaaugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcauggaggugcagaucaugcuggccggcaacgccuucaccgccggcaagcugaucuucgccgccgugcccccccacuuccccaucgagaaccugagccccccccagaucaccauguucccccacgugaucaucgacgugagaacccuggagcccgugcugcugcccaugcccgacaucagaaacagcuucuuccacuucauccagagagacgagcccaagaugagacugguggccaugcuguacaccccccugagaagcaacggcagcggcgacgacguguucaccgugagcugcagagugcugaccagacccacccccgacuucgacuucaccuaccuggugccccccaccguggagagcaagagcaagcccuucacccugcccauccugacccugggcgagcugaccaacagcagauucccccugcccaucgacgugcuguacaccaaccccaacgagagcgccaucgugcagugccagaacggcagaugcacccuggacggcgagcugcagggcaccacccagcugcugcccaccggcaucugcgccuucagaggcaaggugacccagcaggugcaggacgagcacagaggcacccacuggaacaugaccgugaccaaccugaacggcacccccuucgaccccaccgaggacgugcccgccccccugggcacccccgacuucagcggccagaucuacggcgugaucagccagagaaacaccaacaccgugcccggcgagggcgaccugcccgccaacagagcccacgaggccgugaucgccaccuacagccccaaguucacccccaagcugggcaacauccaguucagcaccugggagacccaggacgugagcagcggccagcccaccaaguucacccccgugggccuggccagcguggacgccaacagccacuucgaccaguggacccugcccagcuacagcggcgcccugacccugaacaugaaccuggcccccagcguggcccccguguuccccggcgagugccugcuguucuucagaagcuucaucccccugaagggcggcuacggcaaccccgccaucgacugccugaugccccaggagugggugcagcaccuguaccaggagagcgcccccagccugagcgacguggcccuggugagauacgugaaccccgagaccggcagaacccuguucgaggccaagcugcacagaaacggcuuccugaccguggccagaaacagcgccggccccgugguggcccccaccaacggcuacuucagauucgacagcugggugaaccaguucuacacccuggcccccaugggcaacggcagcggcagaagaagaaugcaguga

SEQ ID NO: 24437 - RNA, 1647 nt, Artificial Sequence
  derived and/or modified sequence opt4 from VP1__Norovirus_and/or_Norovirus-like__AY237415
augaagauggccagcaacgacgccgcccccagcagcgacggcgccgccggccuggugcccgagagcaacaacgaggugauggcccuggagcccguggccggcgccagccuggccgcccccgugaccggccagaccaacaucaucgaccccuggaucagaaugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcauggaggugcagaucaugcuggccggcaacgccuucaccgccggcaagcugaucuucgccgccgugcccccccacuuccccaucgagaaccugagccccccccagaucaccauguucccccacgugaucaucgacgugagaacccuggagcccgugcugcugcccaugcccgacaucagaaacagcuucuuccacuucauccagagagacgagcccaagaugagacugguggccaugcuguacaccccccugagaagcaacggcagcggcgacgacguguucaccgugagcugcagagugcugaccagacccacccccgacuucgacuucaccuaccuggugccccccaccguggagagcaagagcaagcccuucacccugcccauccugacccugggcgagcugaccaacagcagauucccccugcccaucgacgugcuguacaccaaccccaacgagagcgccaucgugcagugccagaacggcagaugcacccuggacggcgagcugcagggcaccacccagcugcugcccaccggcaucugcgccuucagaggcaaggugacccagcaggugcaggacgagcacagaggcacccacuggaacaugaccgugaccaaccugaacggcacccccuucgaccccaccgaggacgugcccgccccccugggcacccccgacuucagcggccagaucuacggcgugaucagccagagaaacaccaacaccgugcccggcgagggcaaccugcccgccaacagagcccacgaggccgugaucgccaccuacagccccaaguucacccccaagcugggcaacauccaguucagcaccugggagacccaggacgugagcagcggccagcccaccaaguucacccccgugggccuggccagcguggacgccaacagccacuucgaccaguggacccugcccagcuacagcggcgcccugacccugaacaugaaccuggcccccagcguggcccccguguuccccggcgagugccugcuguucuucagaagcuucaucccccugaagggcggcuacggcaaccccgccaucgacugccugaugccccaggagugggugcagcaccuguaccaggagagcgcccccagccugagcgacguggcccuggugagauacgugaaccccgagaccggcagaacccuguucgaggccaagcugcacagaaacggcuuccugaccguggccagaaacagcgccggccccgugguggcccccaccaacggcuacuucagauucgacagcugggugaaccaguucuacacccuggcccccaugggcaacggcagcggcagaagaagaaugcaguga

SEQ ID NO: 24438 - RNA, 1647 nt, Artificial Sequence
  derived and/or modified sequence opt4 from VP1__Norovirus_and/or_Norovirus-like__AF504671
augaagauggccagcaacgacgccgcccccagcaacgacggcgccgccggccuggugcccgagagcaacaacgaggugauggcccuggagcccguggccggcgccagccuggccgcccccgugaccggccagaccaacaucaucgaccccuggaucagaaugaacuucgugcaggcccccaacggcgaguucaccgugagccccagaaacagccccggcgaggugcugcugaaccuggagcugggccccgagcugaaccccuaccuggcccaccugagcagaauguacaacggcuacgccggcggcauggaggugcagaucaugcuggccggcaacgccuucaccgccggcaagcugaucuucgccgccgugcccccccacuuccccaucgagaaccugagccccccccagaucaccauguucccccacgugaucaucgacgugagaacccuggagcccgugcugcugcccaugcccgacaucagaaacagcuucuuccacuucauccagagagacgagcccaagaugagacugguggccaugcuguacaccccccugagaagcaacggcagcggcgacgacguguucaccgugagcugcagagugcugaccagacccacccccgacuucgacuucaccuaccuggugccccccaccguggagagcaagagcaagcccuucacccugcccauccugacccugggcgagcugaccaacagcagauucccccugcccaucgacgugcuguacaccaaccccaacgagagcgccaucgugcagugccagaacggcagaugcacccuggacggcgagcugcagggcaccacccagcugcugcccaccggcaucugcgccuucagaggcaaggugacccagcaggugcaggacgagcacagaggcacccacuggaacaugaccgugaccaaccugaacggcacccccuucgaccccaccgaggacgugcccgccccccugggcacccccgacuucagcggccagaucuacggcgugaucagccagagaaacaccaacaccgugcccggcgagggcaaccugcccgccaacagagcccacgaggccgugaucgccaccuacagccccaaguucacccccaagcugggcaacauccaguucagcaccugggagacccaggacgugagcagcggccagcccaccaaguucacccccgugggccuggccagcguggacgccaacagccacuucgaccaguggacccugcccagcuacagcggcgcccugacccugaacaugaaccuggcccccagcguggcccccguguuccccggcgagugccugcuguucuucagaagcuucaucccccugaagggcggcuacggcaaccccgccaucgacugccugaugccccaggagugggugcagcaccuguaccaggagagcgcccccagccugagcgacguggcccuggugagauacgugaaccccgagaccggcagaacccuguucgaggccaagcugcacagaaacggcuuccugaccguggccagaaacagcgccggccccgugguggcccccaccaacggcuacuucagauucgacagcugggugaaccaguucuacacccuggcccccaugggcaacggcagcggcagaagaagaaugcaguga

SEQ ID NO: 24439 - RNA, 1647 nt, Artificial Sequence
  derived and/or modified sequence opt4 from VP1__Norovirus_and/or_Norovirus-like__KJ194504
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacaguucgaccacagauggcacauccagcuggacaaccugaacggcacccccuacgaccccgccgaggacauccccgccccccugggcacccccgacuucagaggcaagguguucggcguggccagccagagaaaccccgacggcaccaccagagcccacgaggccaagguggacaccaccaccaacagauucacccccaagcugggcagccuggagaucaucaccgagagcgaggacuucgacaccaaccagagcaccaaguucacccccgugggcgugggcguggacaacgaggaggaguuccagcaguggagccugcccaacuacagcggccaguucacccacaacaugaaccuggcccccgccguggcccccaacuuccccggcgagcagcugcuguucuucagaagccagcugcccagcagcggcggcuggagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24440 - RNA, 1647 nt, Artificial Sequence
  derived and/or modified sequence opt4 from VP1__Norovirus_and/or_Norovirus-like__KJ194500
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugagccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagagcagcgagagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccggcagcaccagcagagccagcgaccagaccgacacccccacccccagacaguucgacagaagauggcacauccagcuggacaaccugaacggcacccccuacgaccccgccgaggacauccccgccccccugggcacccccgacuucagaggcaagguguucggcguggccagccagagaaaccccgacagagccaccagagcccacgaggccaagguggacaccaccagcgacagauucgcccccaagcugggcagccuggagaucaccaccgagagcggcgacuucgaggccaaccagcccaccaaguucacccccgugggcaucggcguggacaacgaggccgaguuccagcaguggagccugcccaacuacagcggccagaucacccacaacaugaaccuggcccccgccguggcccccaacuuccccggcgagcagcugcuguucuucagaagccagcugcccagcagcggcggcuggagcaacggcgugcuggacugccugcugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24441 - RNA, 1647 nt, Artificial Sequence
  derived and/or modified sequence opt4 from VP1__Norovirus_and/or_Norovirus-like__DQ093063
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagagcgugguggugcagugccagaacggcagagugacccuggacggcgagcugaugggcaccacccagcugcugcccagccagaucugcgccuucagaggcacccugaccagacccaccaacagagccagcgaccaggccgacaccgccacccccagacuguucaaccaccaguggcacauccagcuggacaaccugaacggcacccccuacgaccccgccgaggacauccccgccccccugggcacccccgacuucagaggcaagguguucggcguggccagccagagagaccccgacggcaccaccagagcccacgaggccaagguggacaccaccagcggcagauucacccccaagcugggcagccuggagaucaccaccgagagcgacgacuucaaccagaacaagcccaccagauucacccccgugggcaucggcguggacaacgaggccgacuuccagcaguggauccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagaugggcuucaugaccaucgccaagaacggcgacagccccaucaccgugccccccaacggcuacuucagauucgagagcugggugaaccccuucuacacccuggcccccaugggcaccggcaagggcagaagaagaauccaguga

SEQ ID NO: 24442 - RNA, 1647 nt, Artificial Sequence
  derived and/or modified sequence opt4 from VP1__Norovirus_and/or_Norovirus-like__AY030313
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagagcaucguggugcagugccagaacggcagagugacccuggacggcgagcugaugggcaccacccagcugcugcccaaccagaucugcgccuucagaggcacccugaccagaagcaccaacagagccagcgaccaggccgacaccgccacccccagacuguucgaccaccacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgacuucgaccccaaccagagcaccaaguucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24443 - RNA, 1647 nt, Artificial Sequence
  derived and/or modified sequence opt4 from VP1__Norovirus_and/or_Norovirus-like__U02030
augaagauggccagcaacgacgccgcccccagcaacgacggcgccgccugccuggugcccgagaucaacaacgaggccauggcccuggagcccguggccggcagcgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgacuucgaccccaaccagcccaccaaguucacccccgugggcgugggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24444 - RNA, 1647 nt, Artificial Sequence
  derived and/or modified sequence opt4 from VP1__Norovirus_and/or_Norovirus-like__AB039782
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24445 - RNA, 1647 nt, Artificial Sequence
  derived and/or modified sequence opt4 from VP1__Norovirus_and/or_Norovirus-like__U46039
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguucaccccccugagagccaacaacagcggcgacgacguguucaccgugagcugcagagugcugaccagacccagccccgacuucagcuucaacuuccuggugccccccaccguggagagcaagaucaagcccuucacccugcccauccugcccaucagcgagaugagcaacagcagauuccccgugcccaucgacagccugcacaccagccccaccgagaacaucguggugcagugccagaacggcagagugacccuggacggcgagcugaugggcaccacccagcuguuccccagccagaucugcgccuucagaggcacccugaccagaagcaccagcagagccagcgaccaggccgacaccagcacccccagacuguucaacuacuacuggcacauccagcuggacaaccugaacggcacccccuacgaccccgccgaggacauccccgccccccugggcacccccgacuuccagggcaagguguucggcguggccagccagagaaaccccgacagcaccaccagagcccacgaggccaagguggacaccaccagcggcagauucacccccaagcugggcagccuggagaucagcaccgagagcgacgacuucgacagcaaccagcccaccaaguucacccccgugggcaucggcguggacaacgaggccgacuuccagcaguggagccugcccaacuacagcggccaguucacccacaacaugaaccuggcccccgccguggcccccaucuuccccggcgagcagauccuguucuucagaagccaggugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24446 - RNA, 1647 nt, Artificial Sequence
  derived and/or modified sequence opt4 from VP1__Norovirus_and/or_Norovirus-like__DQ093066
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcaccuucagaggcacccugaccagaagcaccagcagagccagcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucauccccaagcugggcagccuggagaucagcaccgagagcgacgacuucgaccagaaccagcccaccagauucacccccgugggcaucggcguggacaacgaggccggcuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucagcaagaacggcgacagccccaucaccgugccccccaacggcuacuucagauucgagagcugggugaaccccuucuacacccuggcccccaugggcaccggcaacggcagaagaagaauccaguga

SEQ ID NO: 24447 - RNA, 1647 nt, Artificial Sequence
  derived and/or modified sequence opt4 from VP1__Norovirus_and/or_Norovirus-like__DQ093062
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagacccaccagcagagccagcgaccaggccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugaaguacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24448 - RNA, 1647 nt, Artificial Sequence
  derived and/or modified sequence opt4 from VP1__Norovirus_and/or_Norovirus-like__GU930737
augaagauggccagcaacgacgccgcccccagcaacgacggcgccgccaaccuggugcccgaggccaacagcgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcgaggagggcgccaccagagcccacgaggugcacaucgacaccaccaaccccagauacacccccaagcugggcagcguguucaugcacagcgagagcaccgacuucgacgacggccagcccaccagauucacccccaucggcaugggcgccgacgacuggagacagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24449 - RNA, 1647 nt, Artificial Sequence
  derived and/or modified sequence opt4 from VP1__Norovirus_and/or_Norovirus-like__AF414412
augaagauggccagcaacgacgccgcccccagcagcgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcgacgacuucgaccccaaccagcccaccaaguucacccccgugggcaucggcguggacaacgaggccgacuuccagcaguggagccugcccaacuacagcggccaguucacccacaacaugaaccuggcccccgccguggcccccaacuuccccggcgagcagcugcuguucuucagaagccagagacccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24450 - RNA, 1647 nt, Artificial Sequence
  derived and/or modified sequence opt4 from VP1__Norovirus_and/or_Norovirus-like__AB039781
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcgccacccagcugcugcccagccagaucugcgccuucagaggcacccugaccagaagcaccagcagagccagcgaccagaccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaccaccgagagcgacgaccuggacaccaaccagagcaccaaguucacccccgugggcaucggcguggacaacgaggccgaguuccagcaguggagccugcccaacuacagcggccaguucacccacaacaugaaccuggcccccgccguggcccugaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24451 - RNA, 1647 nt, Artificial Sequence
  derived and/or modified sequence opt4 from VP1__Norovirus_and/or_Norovirus-like__LC035073
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcgacgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 24452 - RNA, 1647 nt, Artificial Sequence
  derived and/or modified sequence opt4 from VP1__Norovirus_and/or_Norovirus-like__AF539440
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcgugggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24453 - RNA, 1647 nt, Artificial Sequence
  derived and/or modified sequence opt4 from VP1__Norovirus_and/or_Norovirus-like__AF414414
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaucaccgagagcgacgacuucgacaccaaccagagcaccaaguucacccccgugggcaucggcguggacaacgagagcgaguuccagcaguggagccugcccaacuacagcggccaguucacccacaacaugaaccuggcccccgccguggcccccaacuuccugggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24454 - RNA, 1647 nt, Artificial Sequence
  derived and/or modified sequence opt4 from VP1__Norovirus_and/or_Norovirus-like__AB190457
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24455 - RNA, 1647 nt, Artificial Sequence
  derived and/or modified sequence opt4 from VP1__Norovirus_and/or_Norovirus-like__AF425768
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugagcggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcgacgacuucgaccagaaccagcccaccagauucacccccgugggcgugggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24456 - RNA, 1647 nt, Artificial Sequence
  derived and/or modified sequence opt4 from VP1__Norovirus_and/or_Norovirus-like__AF414415
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcaggccgugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcgacagauucacccccaagcugggcagccuggagaucaucaccgagagcggcgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24457 - RNA, 1647 nt, Artificial Sequence
  derived and/or modified sequence opt4 from VP1__Norovirus_and/or_Norovirus-like__KT779557
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaccgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaucaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugaccagaagcaccagcagagccagcgaccaggccgacgccgccacccccagacuguucaacuaccacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaucagauucacccccgugggcaucggcguggacaacgaggccgacuuccagcaguggacccugcccgacuacagcggccaguucacccacaacaccaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuacaugaccaucgccaagagcggcgacagccccaucaccgugccccccaacggcuacuucagauucgagagcugggugaaccccuucuacacccuggcccccaugggcaccggcaacggcagaagaagaauccaguga

SEQ ID NO: 24458 - RNA, 1647 nt, Artificial Sequence
  derived and/or modified sequence opt4 from VP1__Norovirus_and/or_Norovirus-like__AY247432
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaacggcaacuucguggugcagugccagaacggcagagugacccuggacggcgagcugaugggcaccacccagcugcugcccagccagaucugcgccuucagaggcgugcugaccagacaggugagcagagccggcgaccagaucgacaccgccacccccagaagcuucggcaaccacuggcacauccagcuggacaaccugaacggcacccccuacgaccccgccgaggacauccccggcccccugggcacccccgacuuccagggcaucguguucggcguggccagccagagaaacagcgacggcaccaccagagcccacgaggccaagguggacaccagaaccggcagauucacccccaagcugggcagccuggugaucagcaccgacagcgaggacuuccagcagaacaagcccaccagauucacccccgugggcgugggcguggacagcgaggaggaguucgaccaguggagccugcccgacuacagcggccccaucacccacaacaugaaccuggcccccgccguggcccccaacuuccccggcgagcagcugcuguucuucagaagccagcugcccagcagcggcggcaucagcaagggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaaggacggcgacagccccaucaccgugccccccaacggcuacuucagauucgagagcugggugaaccccuucuacacccuggcccccaugggcaccggcaacggcagaagaagaauccaguga

SEQ ID NO: 24459 - RNA, 1647 nt, Artificial Sequence
  derived and/or modified sequence opt4 from VP1__Norovirus_and/or_Norovirus-like__AF414411
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccuggagaucaaccccuaccuggcccaccuggccagaauguacaacggcuacgccggcguguucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccaagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucggccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucaucaccgagagcgacgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24460 - RNA, 1647 nt, Artificial Sequence
  derived and/or modified sequence opt4 from VP1__Norovirus_and/or_Norovirus-like__AJ277617
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgcccaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgagguguucaccgugagcugcagagugcugaccagacccagccccgacuucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccacccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaaggccgacaccaccagcggcagauucacccccaagcugggcagccuggagaucaucaccgagagcgacgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccugaucccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuaccugagauucgagagcugggugaaccccuucuacacccuggcccccaugggcaccggcaacggcagaagaagaauccaguga

SEQ ID NO: 24461 - RNA, 1647 nt, Artificial Sequence
  derived and/or modified sequence opt4 from VP1__Norovirus_and/or_Norovirus-like__LC036561
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 24462 - RNA, 1647 nt, Artificial Sequence
  derived and/or modified sequence opt4 from VP1__Norovirus_and/or_Norovirus-like__KT732274
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugguggccaugcuguacaccccccugagagccaacaacagcggcgacgacguguucaccgugagcugcagagugcugaccagacccagccccgaguucagcuucaacuuccuggugccccccaccguggagagcaagaccaagcuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaccagauucacccccgugggcaucggcguggacagcgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 24463 - RNA, 1647 nt, Artificial Sequence
  derived and/or modified sequence opt4 from VP1__Norovirus_and/or_Norovirus-like__AY247439
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaacaacaacuucguggugcagugccagaacggcagagugacccuggacggcgagcugaugggcaccacccagcugcugcccagccagaucugcgccuucagaggcgugcuggccagacagaucaacagagccggcgaccagaucgacaccaccacccccagaagcuucgaccaccacuggcacauccagcuggacaaccugaacggcacccccuacgaccccgccgaggacauccccggcccccugggcacccccggcuucaagggcaucguguucggcguggccagccagagaaacagcgacggcaccaccagagcccacgaggccaagguggacaccagaaccggcagauucacccccaagcugggcagccuggugaucagcaccgacagcgaggacagccagcagaacaagcccaccagauucacccccgugggcgugggcguggacaacgaggaggaguucgaccaguggagccugcccaacuacagcggccccaucacccacaacaugaaccuggcccccgccguggcccccaacuuccccggcgagcagcugcuguucuucagaagccagcugcccagcagcggcggcaccagcaagggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaaggacggcgacagccccaucaccgugccccccaacggcuacuucagauucgagagcugggugaaccccuucuacacccuggcccccaugggcaccggcaacggcagaagaagaauccaguga

SEQ ID NO: 24464 - RNA, 1647 nt, Artificial Sequence
  derived and/or modified sequence opt4 from VP1__Norovirus_and/or_Norovirus-like__AF539439
augaagauggccagcagcgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgagcugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacacccccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcggcgacuucgaccagaaccagcccaccagauucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24465 - RNA, 1647 nt, Artificial Sequence
  derived and/or modified sequence opt4 from VP1__Norovirus_and/or_Norovirus-like__AF414413
augaagauggccagcaacgacgccgcccccagcaacgacggcgccgccggccuggugcccgagaucaacaacgaggccauggcccuggagcccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacggcguguucaccgugagcugcagagugcugaccagacccagccccgacuucagcuucaacuuccuggugccccccaccguggagagcaagaccagacuguucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcacccugaccagaagcaccagcagagccagcgaccaggccgacacccccauccccagacuguucaaccacagauggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacgccacccccggcagauucacccccaagcugggcagccuggagaucaucaccgagagcgacgacuucgacaccaaccagagcaccaaguucacccccgugggcaucggcguggacaacgaggccgaguuccagcaguggagccugcccaacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24466 - RNA, 1647 nt, Artificial Sequence
  derived and/or modified sequence opt4 from VP1__Norovirus_and/or_Norovirus-like__AF427112
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagacccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccugcgaccccgccgaggacauccccggcccccugggcacccccgacuucagaggcaagguguucggcguggccagccagagaaaccccgacagcaccaccggcgcccacgaggccaagguggacaccaccgccggcagauucacccccaagcugggcagccuggagaucagcaccgagagcggcgacuucgaccagaaccagcccaccaaguucacccccgugggcaucggcguggaccacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24467 - RNA, 1647 nt, Artificial Sequence
  derived and/or modified sequence opt4 from VP1__Norovirus_and/or_Norovirus-like__AF190817
augaagauggccagcaacgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacccccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgagagccugcacaccggccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacgugcagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgacagcagcgacuucgaccagaaccagcccaccagauucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcgugcuggacugccuggugccccaggagugggcccagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24468 - RNA, 1647 nt, Artificial Sequence
  derived and/or modified sequence opt4 from VP1__Norovirus_and/or_Norovirus-like__LC035072
augaagauggccagcaacgacgccacccccagcaacgacggcgccgccggccuggugcccgagaucaacaacgaggccauggcccuggaccccguggccggcgccgccaucgccgccccccugaccggccagcagaacgugaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgaguucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccccaacggcacccccuacgaccccgccgaggacauccccggcccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcgacgacuucgaccagaaccagcccaccagauucacccccgugggcaucggcguggacagagaggccgacuuccagcaguggagccugcccgacuacagcggccaguucacccacaacaugaaccuggcccccgccguggccgccaacagccccggcgagcagcugaucuucuucuggagccagagccccuacugcggcggcagaagcaacagagugcuggacugcauggugccccaggagugggugcagcacuucuaccaggagagcgcccccgcccagacccagcuggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagagugcaguga

SEQ ID NO: 24469 - RNA, 1647 nt, Artificial Sequence
  derived and/or modified sequence opt4 from VP1__Norovirus_and/or_Norovirus-like__DQ093064
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacgccgaccccaacgagagcaucguggugcagccccagaacggcagaugcacccuggacggcacccugcagggcaccacccagcuggugcccacccagaucugcgccuucagaggcacccugaucagccagaccgccagagccaccgacagcaccgacagcccccagagagccagagaccacccccugcacgugcaggugaagaaccuggacggcacccaguacgaccccaccgacgacauccccgccgugcugggcgccaucgacuucaagggcaccguguucggcguggccagccagagagacgugagcggcccccaggagcagggccacuacgccaccagagcccacgaggcccacaucgacaccaccgaccccaaguacgcccccaagcugggcaccauccugaucaagagcgagagcaacgacuucaucaccaaccagcccaucagauucacccccgugggcaugggcgacaacaacuggagacagugggagcugcccgacuacagcggcagacugacccugaacaugaaccuggcccccgccgugagccccagcuuccccggcgagagaauccuguucuucagaagcaucgugcccagcgccggcggcuacggcagcggcuacaucgacugccugaucccccaggaguggggccagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggcccccaugggcagcggccagggcagaagaagauga

SEQ ID NO: 24470 - RNA, 1647 nt, Artificial Sequence
  derived and/or modified sequence opt4 from VP1__Norovirus_and/or_Norovirus-like__L23830
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccgccaaggugaucuucgccgccaucccccccaacuuccccaucgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugcccagcaccauggagagcaagaccaagcccuucacccugcccauccugaccaucagcgagaugagcaacagcagauuccccgugcccaucgacagccugcacaccagccccaccgagagcaucguggugcagugccagaacggcagagugacccuggacggcgagcugaugggcaccacccagcugcugcccaaccagaucugcgccuucagaggcacccugaccagaagcaccaacagagccagcgaccaggccgacaccgccacccccagacuguucaaccaccacuggcacauccagcuggacaaccugaacggcacccccuacgaccccgccgaggacauccccgccccccugggcacccccgacuucagaggcaagguguucggcguggccggccagagaaaccccgacagcaccaccagagcccacgaggccaagguggacaccaccagcggcagauucacccccaagcugggcagccuggagaucaccaccgagagcgacgacuucgaccccaaccagagcaccaaguucacccccgugggcaucggcguggacaacgaggccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcaccggcaacggcagaagaagaauccaguga

SEQ ID NO: 24471 - RNA, 1647 nt, Artificial Sequence
  derived and/or modified sequence opt4 from VP1__Norovirus_and/or_Norovirus-like__KX907728
augaagauggccagcaacgacgccccccccagcagcgacggcgccggcaaccuggugcccgagagccaccaggaggugcugccccuggcccccguggccggcgccgagcuggccgcccccguggugggccagaccaacaucaucgaccccuggaucaaggagaacuucgugcaggccccccagggcgaguucaccgugagccccaagaacgcccccggcgagauccuggugaaccuggagcugggccccaaccugaaccccuaccuggagcaccugagcagaauguacaacgccuacgccggcggcaucgagguggagaucauccuggccggcaacgccuucaccgccggcaagauccugaucgccgccgugccccccaacuuccccguggagagcgugagcgccagccaggccacccaguucccccacgccaucguggacgugagaacccuggagcccgugagacugccccugcccgacgugagaagcaacuucuuccacuacaccaccaaggacgagcccaagaugagacuggugaucuggcuguacaccccccugagaaccaacggcagcggcgacgacagcuucaccgugagcggcagacugcugaccagacccagcauggacuuccaguucagcuuccuggugccccccaccguggagaccaagaccgugcuguucaccgugcccggccugaccccccaggagaugagcaacagcagauggcccgcccagaucagcggcaugguggugagaggcaacgagccccagguggugcaguuccagaacggcagaugccacaccgacggcacccugcugggcaccaccaccgugagcgagcagugcaucgccggcuucgugggcaccagcaccaacaccagaagcgccaccggcagcaccaccgagaccagaaccggcgacaccgaccuguggcugagacuggaggagcccaacggccagcccuacgacaucuucggcgaccagcccgccccccugggcacccccgacuucagagccgugaucgugggcuucgccagcagaccccagacccagggcagcuacaugaacgaggccuacgugaacaccguggacagccacuucgcccccgccaccggcaacaccaagaucauccugagaagaggcggcaccggccacgugggcggcggccaccuguggaaguucagacccuucggcguggagggcggcgagggcagagugagcuaccaggaguacgugcugcccaacuacagcggcgccaccgccagcaaccacaaccuggccccccccguggcccccagaaugcccggcgagcugcugcugcuguucgagagcgacaugcccgugugggacgacggccacggcgccgcccccgcccagaagauccacugccugcugccccagcaguucaucacccacuucuucgacagccaggcccccgcccuggccgaggccgcccugcugagauacgugcaccccgacagcagcagagugcuguucgagaccaagcuguacagagagggcuucaugguggugagcgcccccaccggcagauucgacuucccccuggacggcuacuucagauucgacagcugggugaacagcuucuacgugcugagccccgugggcagcggccagggcagaagauga

SEQ ID NO: 24472 - RNA, 1644 nt, Artificial Sequence
  derived and/or modified sequence opt4 from VP1__Norovirus_and/or_Norovirus-like__AB039779
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagacccccagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcgugggcgccaccagagcccacgaggugcacaucgacaccaccaaccccagauacacccccaagcugggcagcgugcugauguacagcgagagcagcgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacgcccugacccccaugggcaccggccagggcagaagaagagugcaguga

SEQ ID NO: 24473 - RNA, 1644 nt, Artificial Sequence
  derived and/or modified sequence opt4 from VP1__Norovirus_and/or_Norovirus-like__AB039778
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcgugggcgccaccagagcccacgaggugcacaucgacaccaccaaccccagauacacccccaagcugggcagcgugcugauguacagcgagagcagcgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24474 - RNA, 1644 nt, Artificial Sequence
  derived and/or modified sequence opt4 from VP1__Norovirus_and/or_Norovirus-like__KY424345
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagggcaucguggugcagccccagaacggcagaugcacccuggacggcacccugcagggcaccacccagcuggugcccacccagaucugcgccuucagaggcacccugaucggccagaccagcagaagcagcgacagcaccgacagcgcccccagaagaagagaccacccccugcacgugcagcugaagaaccuggacggcacccaguacgaccccaccgacgaggugcccgccgugcugggcgccaucgacuucaagggcgccguguucggcguggccagccagagagacgugagcggcacccaggugggcgccaccagagcccacgaggugcacaucaacaccaccgaccccagauacacccccaagcugggcagcauccugaugcacagcgagagcgacgacuucgugaccggccagcccauccaguucacccccgugggcaugggcgacaacgacuggcaccagugggagcugcccgacuacagcggccaccugacccugaacaugaaccuggcccccgccguggcccccgccuuccccggcgagagaauccuguucuucagaagcaucgugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagaaaccaguga

SEQ ID NO: 24475 - RNA, 1644 nt, Artificial Sequence
  derived and/or modified sequence opt4 from VP1__Norovirus_and/or_Norovirus-like__HQ169542
augaugauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccuggugagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcggcagcgugggcgccaccagagcccacgaggugcacaucgacaccaccaaccccagauacacccccaagcugggcagcgugcugauguacagcgagagcagcgacuucgacgacggccagcccaccagauucacccccaucggcaugggcgccgacgacuggagacagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24476 - RNA, 1644 nt, Artificial Sequence
  derived and/or modified sequence opt4 from VP1__Norovirus_and/or_Norovirus-like__KX228762
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugaugcacagcgagagcaacgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24477 - RNA, 1644 nt, Artificial Sequence
  derived and/or modified sequence opt4 from VP1__Norovirus_and/or_Norovirus-like__AF414410
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagauccugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccguguuccugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgagaccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagccagaaaccacccccugcacgugcagcugaagaaccuggacggcacccccuacgaccccaccgacgaggugcccgccgugcugggcgccaucgacuucaagggcaccguguucggcguggccagccagagaaacaccaccggcagcagcgugggcgccaccagagcccacgaggugcacaucgacaccaccgaccccagauacacccccaagcugggcagcgugcugauguacagcgagagcaacgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccagaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24478 - RNA, 1644 nt, Artificial Sequence
  derived and/or modified sequence opt4 from VP1__Norovirus_and/or_Norovirus-like__KU935739
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagccagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugauguacagcgagagcaacgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24479 - RNA, 1644 nt, Artificial Sequence
  derived and/or modified sequence opt4 from VP1__Norovirus_and/or_Norovirus-like__KX268709
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagccagaaaccacccccugcacgugcagcugaagaaccuggacggcacccccuacgaccccaccgacgaggugcccgccgugcugggcgccaucgacuucaagggcaccguguucggcguggccagccagagaaacaccaccggcaacagcaucggcgccaccagagcccacgaggugcacaucgacaccaccaaccccagauacacccccaagcugggcagcgugcugaugcacagcgagagcaccgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaccggccagggcagaagaagagugcaguga

SEQ ID NO: 24480 - RNA, 1644 nt, Artificial Sequence
  derived and/or modified sequence opt4 from VP1__Norovirus_and/or_Norovirus-like__KX158282
augaagauggccagcaacgacgccgcccccagcaacgacggcgccgccaaccuggugcccgaggccaccaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggagaacaucagcgccgcccagaucaccaugugcccccacgugaucguggacgugagacagcuggagcccgugcugcugccccugcccgacaucagaaacagauucuuccacuacaaccaggagaacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgcccccaucgacaugcuguacaccgaccccaacgaggccaucguggugcagccccagaacggcagaugcacccuggacggcacccugcagggcaccacccagcuggugcccacccagaucugcagcuucagaggcacccugaucagccagaccagcagaagcgccgacagcaccgacagcgcccccagagugagaaaccacccccugcacgugcagcugaagaaccuggacggcacccccuacgaccccaccgacgaggugcccgccgugcugggcgccaucgacuucaagggcaccgugcugggcguggccagccagagaaacaccaccggcagcagcaucggcgccaccagagcccacgaggugcacaucgacaccaccaaccccagauacacccccaagcugggcagcgugcugaugcacagcgagagcaccgacuucgacgacggccagcccaccagauucacccccaucggcaugggcgccgacgacuggcaccagugggagcugcccgaguacagcggccaccugacccugaacaugaaccuggcccccgccguggcccccgccuuccccggcgagagaauccuguucuucagaagcguggugcccagcgccggcggcuacggcagcggccacaucgacugccugaucccccaggagugggugcagcacuucuaccaggaggccgcccccagccagagcgccguggcccugaucagauacgugaaccccgacaccggcagaaacaucuucgaggccaagcugcacagagagggcuucaucaccguggccaacagcggcaacaaccccaucguggugccccccaacggcuacuucagauucgaggccugggugaaccaguucuacacccugacccccaugggcaucggccagggcagaagaagagugcaguga

SEQ ID NO: 24481 - RNA, 1644 nt, Artificial Sequence
  derived and/or modified sequence opt4 from VP1__Norovirus_and/or_Norovirus-like__AB126320
augaagauggccagcagcgacgccgcccccagcaccgacggcagcgccagacuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccagccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcaccaucggcgacggccagcccgccagccacagcgaggaggagaucaugcccauggccuucaacauccagagagagaucaugcuggagaaccuggacggcacccccuacgaccccgccgacgacauccccgccgugcugggcagccccgacuuccagggcgugaucuucggcauccugagccagagaaacaccgacggccagaccagagcccacgaggccaagguggacaccagagccgccagauucgcccccaagcugggcuucgugguggccaccguggagagcaccgacuuccacgccaaccagcccagcagauucacccccgugggccugggcggcgacaacaaccaggacuucaaccaguggagacugcccgccuacggcggcgcccugaccaacaacaccaaccuggccccccccgugaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagagccagauga

SEQ ID NO: 24482 - RNA, 1644 nt, Artificial Sequence
  derived and/or modified sequence opt4 from VP1__Norovirus_and/or_Norovirus-like__AY077644
augaagauggccagcaacgacgccagccccagcgccgacggcagcgccggccuggugcccgaggugaacaacgagaccauggcccuggagcccguggugggcgccccccuggccgcccccguggccggccagcacaacaucaucgaccccuggaucaagaugaacuucgugcaggcccccaacggcgaguucaccgugagccccagaaacgcccccggcgagauccugcuggaccuggagcugggccccgaccugaaccccuaccugagccaccuggccagaauguacaacggcuacgccggcggcauggaggugcagguggugcuggccggcaacgccuucaccgccggcaagaucaucuucgccgccgugccccccaacuuccccgccgagaaccugagcgccgcccaggugaccaugugcccccacgugaucguggacgugagacagcuggagcccgugaugcugcccaugcccgacaucagaaacaagcuguuccacuacaaccagguggacgaccccaagcugagacugcuggccuaccuguacaccccccugagagccaacaacgccggcgacgacguguucaccgugagcugcagagugcugaccagacccacccccgacuucgaguucauguuccuggugccccccaccguggagagcaagaccaagcccuucagccugcccagccugacccuggacgagcugagcaacagcagauuccccgcccccaucgugcagcuguacaccaacccccacgacaaccugguggugcagccccagaacggcagaugcaccaucgacggccugcugcagggcaccacccagcuggugagcugcaacgugugcagcuucagaggcacccugggcgacggccagcccgccagccacagcgaggaggagaucaugcccauggccuucaacauccagagagagaucaugcuggagaaccuggacggcagccccuacgaccccaccgacgacauccccgccgugcugggcagccccgacuuccagggcgugguguucggcauccugagccagagaaacaccgacggccagaccagagcccacgaggccaagguggacaccagacuggccagauucgcccccaagcugggcuucgugguggccaccguggagaacaccgacuuccacgccaaccagcccugcagauucacccccgugggccugggcggcgacaacaacagagacuucaaccaguggggccugcccgccuacggcggcgcccugaccaacaacaccaaccuggccccccccgugaugcccguguaccccggcgagcagcugcuguucuucagaagccagcugcccagcagcggcggcguggugggcggcuggcuggacugccugcugccccaggagugggugcagcacuucuuccaggagagcgccaccagccagagcgacguggcccuggugagauacaucaaccccaccaccggcagagugcuguucgaggccaagcugcacaagcagggcuuccugaccguggccgccagcggcagcuacccccugguggugcccgccgacggcuacuucagauucgagagcugggugaaccaguucuacacccuggcccccaugggcaacggcagcggcagaagaagagugagauga

SEQ ID NO: 24483 - RNA, 1644 nt, Artificial Sequence
  derived and/or modified sequence opt4 from VP1__Norovirus_and/or_Norovirus-like__AY823306
augaagauggccagcagcgacgccgcccccagcagcgacggcagcgccggccuggugcccgaggugaacagcgagaccauggcccuggagcccguggugggcgccccccuggccgcccccguggccggccagcacaacaucaucgaccccuggaucaagcugaacuucgugcaggcccccaacggcgaguucaccgugagccccagaaacgcccccggcgagauccugcuggaccuggagcugggccccgaccugaaccccuaccuggcccaccugagcagaauguacaacgccuacgccggcggcauggaggugcaggugauccuggccggcaacgccuucaccgccggcaagaucaucuucgccgccgugccccccaacuucccccuggagaaccugagcgccgcccagaucaccaugugcccccacaucaucguggacgugagacagcuggagcccgugaugcugcccaugcccgacgugagaaacagacuguuccacuacaaccaggugagagagcccagacugagacugguggccuaccuguacaccccccugagagccaacaacgccggcgacgacguguucaccgugagcugcagagugcugaccagacccagccaggacuucgaguucauguuccuggugccccccagcguggagagcaagaccaagcccuucagccugcccaaccugacccuggccgagcugagcaacagcagauucccccugcccaucgagcagcuguacaccaacccccuggacaaccugguggugcagccccagaacggcagaugcaccaucgacggcauccugcugggcaccacccagcuggugcccagccugaucugcagcaugagaggcacccuggaggccgaccaggccagcggccacaccgacgacgagagcgugcagagcagagccuucaacagacagagaagccugaugcuggagaaccccgacggcagcgccuucgaccccagcgacgaggugcccgccgugcugggcgugcccgacuucagaggcgugguguucggcgugcugagccagagaaacaacggcgacaccaccagaagccacgaggccaagaucgacaccagaagacccagauacgcccccaagcugggcuucguggaggugcugaccgagagcgacgacuuccagaacggcccccccaccaaguucacccccgugggccugggcggcgacggcaaccccgacuuccagcagugggcccugcccgacuacggcggcgcccugaccaacaacaccaaccuggccccccccguggugcccguguaccccggcgagcagauccuguucuucagaagccagcugcccagcagcggcggcaccguggccggcuggcuggacugccugcugccccaggaguggauccagcacuucuaccaggacagcgccgccgcccagagcgacguggcccuggugagauacaucaaccccgccaccggcagagugcuguucgaggccaagcugcacagacagggcuuccugaccgugagcgccgccggcccccaccccgugguggcccccgccgacggcuacuucagauucgagagcugggugaaccaguucuacacccuggcccccaugggcaacggcagcggcagaagaagaguguga

SEQ ID NO: 24484 - RNA, 1638 nt, Artificial Sequence
  derived and/or modified sequence opt4 from VP1__Norovirus_and/or_Norovirus-like__KF586508
augaugauggccagcaaggacgccaccagcaacauggacggcaccagcggcgccggccagcuggugcccgagaacaacaacaccagcgagcccaucaacauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccuggcccaccugagccagauguacaacggcugggugggcaacaugaaggugagaguggugcuggccggcaacgccuucagcgccggcaagaucaucgugugcugcaucccccccggcuucagcgcccccaacaucagcaucgcccaggccaccauguucccccacgugaucgccgacgugagagugcuggagcccaucgacaucccccuggacgacgugagaaacgugcuguuccacaacaacgacaacggcaaccagaccaugagacugcugugcaugcuguacaccccccugagaagcggcggcaccagcagcggcaccgaccccuucgugaucgccggcagagugcugaccugccccacccccgacuucaacuuccuguuccuggugccccccaccguggagcagaagaccaagcaguucagcgugcccaaccugccccugaacgugaugagcaacagcagagugcccagccugcugaacgccaugguggugagccccgaccaggcccagguggugcaguuccagaacggcagaugcacccuggacggccagaugcugggcaccaccaccgugagcgccagcugcguggccagauucagaggcaagaccuuccaggcccccgacaacagacugggcaucaaccuggccgagaucagcggcgagcccuaccacgccuucgagagccccgccccccugggcuuccccgacuucggcgacggcgacuggcacgugaccgccaccaaggugacccccagccagcuggaggccaacgaccccguggugaugggcaacgugcagcccuacaacccccaguucgccccccaccugggcacccuggugguggagaaccccacccccgacaacgugaccaccggcaccgaccugcuguucaacaucaccuggcugagcaacagagccaacaacagauucaaccccugggugauccccaacuacggcagcacccugaccgaggccgcccagcuggcccccagcaucuucccccccggcuucggcgagaccaucguguacuucaacagcaccuuccccgccgugggcgccaccacccacgccgccauccccugccugcugccccaggaguucguggcccacuucgugaacgagcaggcccccaucagaggcgaggccgcccugcugcacuacaucgaccccgacacccacagaaaccugggcgaguucaagaucuaccccgagggcuucgugaccugcgugcccaacgugggcggcaccggcccccagagccugcccaccaacggcaucuucguguucgugagcugggugagcagauacuaccagcugaagcccgugggcaccgccggccaggccagaagacuguga

SEQ ID NO: 24485 - RNA, 1638 nt, Artificial Sequence
  derived and/or modified sequence opt4 from VP1__Norovirus_and/or_Norovirus-like__HQ637267
augaugauggccagcaaggacgccaccagcaacauggacggcaccagcggcgccggccagcuggugcccgagaacaacaacaccagcgagcccaucaacauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccuggcccaccugagccagauguacaacggcugggugggcaacaugaaggugagaguggugcuggccggcaacgccuucagcgccggcaagaucaucgugugcugcaucccccccggcuucagcgcccccaacaucagcaucgcccaggccaccauguucccccacgugaucgccgacgugagagugcuggagcccaucgacaucccccuggacgacgugagaaacgugcuguuccacaccaacgacaacggcaaccagaccaugagacugcugugcaugcuguacaccccccugagaagcggcggcaccagcagcggcaccgaccccuucgugaucgccggcagagugcugaccugccccacccccgacuucaacuuccuguuccuggugccccccaccguggagcagaagaccaagcaguucagcgugcccaaccugccccugaacgugaugagcaacagcagagugcccagccugcugaacgccaugguggugagccccgaccaggcccagguggugcaguuccagaacggcagaugcacccuggacggccagaugcugggcaccaccaccgugagcgccagcugcguggccagauucagaggcaagaccuuccaggcccccgacaacagacugggcaucaaccuggccgagaucagcggcgagcccuaccacgccuucgagagccccgccccccugggcuuccccgacuucggcgacggcgacuggcacgugaccgccaccaaggugacccccagccagcuggaggccaacgaccccgugguggugggcaacgugcagcccuacaacccccaguucgccccccaccugggcacccuggugguggagaaccccacccccgaccagguggccaccggcaccgaccugcuguucaacaucaccuggcugagcaacagagccaacaacagauucaaccccugggugauccccaacuacggcagcacccugaccgaggccgcccagcuggcccccagcaucuucccccccggcuucggcgagaccaucguguacuucaacagcaccuuccccgccgugggcgccaccacccacgccgccauccccugccugcugccccaggaguucguggcccacuucgugaacgagcaggcccccaucagaggcgaggccgcccugcugcacuacaucgaccccgacacccacagaaaccugggcgaguucaagaucuaccccgagggcuucgugaccugcgugcccaacgugggcggcaccggcccccagagccugcccaccaacggcguguucguguucgugagcugggugagcagauacuaccagcugaagcccgugggcaccgccggccaggccagaagacuguga

SEQ ID NO: 24486 - RNA, 1629 nt, Artificial Sequence
  derived and/or modified sequence opt4 from VP1__Norovirus_and/or_Norovirus-like__AY134748
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcaggacaacgaccaccuguacaacaucaccaucaccaaccugaacggcagccccuucgaccccagcgaggacauccccgccccccugggcgugcccgacuuccagggcagaguguucggcgugaucacccagagagacaagcagaacgccgccggccagagccagcccgccaacagaggccacgacgccguggugcccaccuacaccgcccaguacacccccaagcugggccaggugcagaucggcaccuggcagaccgacgaccugaaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24487 - RNA, 1629 nt, Artificial Sequence
  derived and/or modified sequence opt4 from VP1__Norovirus_and/or_Norovirus-like__AY054300
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugcccaucgaccagauguucaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcagaacgccgccggccacagcgagcccgccaacagaggccacgacgccguggugcccaccuacaccgcccaguacacccccaagcugggccagauccagaucggcaccuggcagaccgacgaccugcaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24488 - RNA, 1629 nt, Artificial Sequence
  derived and/or modified sequence opt4 from VP1__Norovirus_and/or_Norovirus-like__KY485125
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgagaucaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24489 - RNA, 1629 nt, Artificial Sequence
  derived and/or modified sequence opt4 from VP1__Norovirus_and/or_Norovirus-like__KY485123
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggccacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24490 - RNA, 1629 nt, Artificial Sequence
  derived and/or modified sequence opt4 from VP1__Norovirus_and/or_Norovirus-like__KY485126
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgagaucaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaucaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24491 - RNA, 1629 nt, Artificial Sequence
  derived and/or modified sequence opt4 from VP1__Norovirus_and/or_Norovirus-like__U70059
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccagcaagggcgaggugaccgcccaccugcaggacaacgaccaccuguacaacaucaccaucaccaaccugaacggcagccccuucgaccccagcgaggacauccccgccccccugggcgugcccgacuuccagggcagaguguucggcgugaucacccagagagacaagcagaacgccgccggccagagccagcccgccaacagaggccacgacgccguggugcccaccuacaccgcccaguacacccccaagcugggccaggugcagaucggcaccuggcagaccgacgaccugaaggugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuaccugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24492 - RNA, 1629 nt, Artificial Sequence
  derived and/or modified sequence opt4 from VP1__Norovirus_and/or_Norovirus-like__LC145808
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgcccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24493 - RNA, 1629 nt, Artificial Sequence
  derived and/or modified sequence opt4 from VP1__Norovirus_and/or_Norovirus-like__LC145795
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccaucaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24494 - RNA, 1629 nt, Artificial Sequence
  derived and/or modified sequence opt4 from VP1__Norovirus_and/or_Norovirus-like__AB629941
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagacuguacaacggcuacgccggcggcauggaggugcaggugaugcuggccggcaacgccuucaccgccggcaagcugguguuccccgccgugcccccccacuuccccaucgagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugagccagcccgugaaguucacccccgugggccugaacgacaucgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24495 - RNA, 1629 nt, Artificial Sequence
  derived and/or modified sequence opt4 from VP1__Norovirus_and/or_Norovirus-like__LC145792
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccagugggugcugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24496 - RNA, 1629 nt, Artificial Sequence
  derived and/or modified sequence opt4 from VP1__Norovirus_and/or_Norovirus-like__LC145786
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacagccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24497 - RNA, 1629 nt, Artificial Sequence
  derived and/or modified sequence opt4 from VP1__Norovirus_and/or_Norovirus-like__LC145793
augaagauggccagcaacgacgccgcccccagcaccgacggcgccgccggccuggugcccgagagcaacaacgaggugauggcccuggagcccguggccggcguggcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucgagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24498 - RNA, 1629 nt, Artificial Sequence
  derived and/or modified sequence opt4 from VP1__Norovirus_and/or_Norovirus-like__LC145791
augaagauggccagcaacgacguggcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24499 - RNA, 1629 nt, Artificial Sequence
  derived and/or modified sequence opt4 from VP1__Norovirus_and/or_Norovirus-like__LC145788
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccuggccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24500 - RNA, 1629 nt, Artificial Sequence
  derived and/or modified sequence opt4 from VP1__Norovirus_and/or_Norovirus-like__LC145803
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagcagcuucgaccccagcgaggacauccccgccccccugggcauccccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24501 - RNA, 1629 nt, Artificial Sequence
  derived and/or modified sequence opt4 from VP1__Norovirus_and/or_Norovirus-like__LC145804
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccuggccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24502 - RNA, 1629 nt, Artificial Sequence
  derived and/or modified sequence opt4 from VP1__Norovirus_and/or_Norovirus-like__LC145801
augaagauggccagcaacgacgccgcccccagcaccgacggcgccgccggccuggugcccgagagcaccaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgcccccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24503 - RNA, 1629 nt, Artificial Sequence
  derived and/or modified sequence opt4 from VP1__Norovirus_and/or_Norovirus-like__LC145802
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggccacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgaguucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggccagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgcccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucgaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24504 - RNA, 1629 nt, Artificial Sequence
  derived and/or modified sequence opt4 from VP1__Norovirus_and/or_Norovirus-like__LC145805
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccuggccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagugggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24505 - RNA, 1629 nt, Artificial Sequence
  derived and/or modified sequence opt4 from VP1__Norovirus_and/or_Norovirus-like__LC145797
augaagauggccagcaacgacgccgcccccagcaccgacggcgccgccggccuggugcccgagagcaacaacgaggugauggcccuggagcccguggccggcguggcccuggccgcccccgugaccggccagaccaacaucaucgaccccuggaucagagccaacuucgugcccgcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcuguucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacaucagcggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24506 - RNA, 1629 nt, Artificial Sequence
  derived and/or modified sequence opt4 from VP1__Norovirus_and/or_Norovirus-like__LC145806
augaagauggccagcaacgacgccgcccccagcaccgacggcgccgccggccuggugcccgagagcaacagcgaggugauggcccuggagcccguggccggcgccgcccuggccgcccccgugaccggccagaccaacaucaucgaccccuggaucagagccaucuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccuggccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagaauccaguga

SEQ ID NO: 24507 - RNA, 1629 nt, Artificial Sequence
  derived and/or modified sequence opt4 from VP1__Norovirus_and/or_Norovirus-like__KU306738
augaagauggccagcaacgacgccgcccccagcaacgacggcgccagcagccuggugcccgagaucaacaacgagaccauggcccuggagcccguggccggcggcgccaucgccgccccccugaccggccagaccaacuucaucgaccccuggaucagaaacaacuacgugcaggcccccaacggcgaguucaccaucagccccagaaacagccccggcgagauccugcugaaccuggagcugggccccgagcugaaccccuuccuggcccaccuggccagaauguacaacggcuacgccggcggcguggacgugcaggugaucauggccggcaacgccuucaccgccggcaaggugaucuucgccgccgugcccccccacuuccccguggagagccugagccccccccagaucaccauguucccccacaucaucguggacgugagaacccuggagcccaucaacauccccauccccgacgugagaaacaacuucuuccacuacaaccagaacaacgagcccagaaugagacugguggccaugcuguacaccccccugagaagcaacggcagcgccgacgacguguucaccgugagcugcagagugcugaccaagcccagcgccgacuucgaguucaacuaccuggugccccccaccguggagagcagaaccaagcccuucaccauccccauccugaccaucggcgagaugaccaacagcagauuccccguggccaucgacaugcuguacaccagccccaccgagaaccugguggugcagccccagaacggcagaugcacccuggagggcgagcugcugggcaccacccagcuggugacccccaacaucugcagccugagaggcgccaucaccggccacgagggcaacgacgacaaccacaaguggcacaugaccgugaccaaccccaacggcagcgccuucgaccccaccgaggacgugcccgccccccugggcacccccgacuucaucggcgacguguacggcgugcugagccagagaaacagaaacaucgagagcggccagaccgcccccgccaacagaagccacgaggccgugaucagcaccagaagcaacaaguucacccccaagcugggcagcgugaugaucgccaccuggaacaccaacgacguggagaaccagcccaccaaguucacccccgugggccuggagaaccccggcagcuuccaccagugggagcugcccaacuacagcggcgcccugacccugaacaugggccuggccccccccguguuccccaccuaccccggcgagcagcugcuguucuucagaagcuacaucccccugaagggcggcuucggcaacagcaucaucgacugccuggugccccaggaguggauccagcacuucuaccaggagagcgcccccagccagaccgacguggcccugaucagauacgugaaccccgagaccggcagagugcuguucgaggccaagcugcacagacagggcuucaucaccguggccaagaccggcgacagccccaucaacgugcccgccaacggcuacuucagauucgacagcugggugaacagcuucuacagccuggcccccaugggcaccggcaacggcagaagaagaauccaguga

SEQ ID NO: 24508 - RNA, 1629 nt, Artificial Sequence
  derived and/or modified sequence opt4 from VP1__Norovirus_and/or_Norovirus-like__KM036380
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcagauucacccccaagaucggcaccaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcaacuacccccugguggugccccccaacggccacuucagauucgacagcugggugaaccaguucuacagccuggcccccaugggcaccggcaacggcagaagaagagugcaguga

SEQ ID NO: 24509 - RNA, 1629 nt, Artificial Sequence
  derived and/or modified sequence opt4 from VP1__Norovirus_and/or_Norovirus-like__AY113106
augaagauggccagcaacgacgccgcccccagcaacgacggcgccgccagccuggugcccgagggcaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaccaacguggugcagugccagaacggcagaugcacccuggacggcgagcugcagggcaccacccagcugcugagcagcgccgugugcagcuacagaggcagaaccguggccaacaacggcgacaacugggaccagaaccugcugcagcugaccuaccccaacggcgccagcuacgaccccaccgacgaggugcccgccccccugggcacccaggacuucagcggcaugcuguacggcgugcugacccaggacaacgugaacgugagcaccggcgaggccaagaacgccaagggcaucuacaucagcaccaccagcggcaaguucacccccaaggugggcagcaucggccugcacagcaucaccgagcacgugcaccccaaccagcagagcagauucacccccgugggcguggccgugaacgagaacacccccuuccagcagugggugcugccccacuacgccggcagccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaauccaguga

SEQ ID NO: 24510 - RNA, 1629 nt, Artificial Sequence
  derived and/or modified sequence opt4 from VP1__Norovirus_and/or_Norovirus-like__AB078334
augaagauggccagcaacgacgccgcccccagcaacgacggcgccgccagccuggugcccgagggcaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccugguggacaugaucagccccgcccagaucaccaugcugccccaccugaucguggacgugagaacccuggagcccaucaugaccccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaccaacguggugcagugccagaacggcagaugcacccuggacggcgagcugcagggcaccacccagcugcugagcagcgccgugugcuuccugcagggcagaaccguggccgacaacggcgacaacugggaccagaaccugcugcagcugaccuaccccaacggcgccagcuacgaccccaccgacgaggugcccgccccccugggcacccaggacuucagcggcaugcuguacggcgugcugacccaggacaacgugaacgugagcaccggcgaggccaagaacgccaagggcaucuacaucagcaccaccagcggcaaguucacccccaagaucggcagcaucggccugcacagcaucaccgagcacgugcaccccaaccagcagagcagauucacccccgugggcguggccguggacgagaacacccccuuccagcagugggugcugccccacuacgccggcagccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaauccaguga

SEQ ID NO: 24511 - RNA, 1629 nt, Artificial Sequence
  derived and/or modified sequence opt4 from VP1__Norovirus_and/or_Norovirus-like__KM289172
augaagauggccagcaacgacgccgcccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaaggugaucuucgccgccaucccccccaacuuccccaccgacaaccugagcgccgcccagaucaccaugugcccccacgugaucguggacgugagacagcuggagcccaucaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgacaacaucguggugcagugccagaacggcagagugacccuggacggcgagcugaugggcaccacccagcugcugcccagccagaucugcgccuucagaggcgugcugaccagaagcaccagcagagccagcgaccaggccgacaccgccacccccagacuguucaacuacuacuggcacauccagcuggacaaccugaacggcacccccuacgaccccgccgaggacauccccgccccccugggcacccccgacuucagaggcaagguguucggcguggccagccagagaaaccccgacagcaccaccagagcccacgaggccaagguggacaccaccagcggcagauucacccccaagcugggcagccuggagaucagcaccgagagcggcgacuucgaccagaaccagcccaccagauucacccccgugggcaucggcguggacagcgaggccgacuuccagcaguggacccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuacaugaccaucgccaagagcggcgacagccccaucaccgugccccccaacggcuacuucagauucgagagcugggugaaccccuucuacacccuggcccccaugggcaccggcaacuga

SEQ ID NO: 24512 - RNA, 1629 nt, Artificial Sequence
  derived and/or modified sequence opt4 from VP1__Norovirus_and/or_Norovirus-like__AY130762
augagaauggccagcagcgacgcccccgugagcggcaccgacggcgccgccggccuggugcccgagagccagcaggaggugcugccccuggagcccguggccggcgugcagcuggccgcccccguggccggccagagcaacaucaucgaccccuggaucagaaugaacuucgugcaggcccccgccggcgaguucaccgugagccccagaaacgcccccggcgaggugcugaucgaccuggagcugggccccgagcugaaccccuaccugaaccaccuggccagaauguacaacggcuacgugggcggcauggagguggagguggugcuggccggcaacgccuucaccgccggcaagauccuguucgccgccgugccccccagcuuccccacccacggcaucagcgccgcccaggccaccaugcugccccacgugaucguggacgugagacagcuggagcccgugagacugccccugcccgacgugagaaacgugauguuccacuucugccaggagaacaaggagcccagaaugagaaucguggccauccuguacaccccccugagagccaacggcgccggcgacgacguguucaccgugagcugcagagugcugaccagacccagccccgacuucgacuucaucuuccuggugccccccagcguggagagcaagcugaagcaguucacccugcccaaccugcagcccaacgagaugaccaacagcagauuccccaccggcaucacccagcuguacaccagccccaacaccaaccugguggugcaguuccagaacggcagaugccugcuggacggcacccugcugggcaccacccccgugagagccgccgacaucugcagcuucagaggcgugaccagcaccgagguggacgccaccgacagccccagaguggccggcagccacagaaucauggugcagcugaaggagcccgacggcgaggaguucagccccaccggccccaaccccgcccccgugggcacccccgacuuccaggccgccaucuucggcacccugagccagagaaacaccggcggcgccggccagaacagcaacagagcccacuucgccuacuucuacaccagaaaccccaccuucgcccccggcaucggcaccgugguguucagcuucgacaccaccgacuuccagaacagacagcccaccaaguucagccccagcggcguguucgacgacaacagcagcgagcccuucaaccaguucagccugcccuacuacaacggcagccugggcgccguggacgccggcaagcuggccccccccguggcccccaacuaccccggcgagcagauccuguacuucagaggcaacauccccuucaagggcggcuacggcgagggcgagaucgacagccugcugccccaggaguggaucacccacuucuacgccgagcaggcccccacccagggcgacgccgcccugcugagauacuacaaccccgacaccggcagagugcuguucgagugcaagcugcacagagagggcuucaucaccaucaacuacaccggcagcaacgcccuggccgugcccgugaacggcguguucagauucgagggcugggugaacaaguucuacacccugacccccauguga

SEQ ID NO: 24513 - RNA, 1629 nt, Artificial Sequence
  derived and/or modified sequence opt4 from VP1__Norovirus_and/or_Norovirus-like__KJ196290
augagaauggccagcagcgacgcccccgugagcggcaccgacggcgccgccggccuggugcccgagagccagcaggaggugcugccccuggagcccguggccggcgugcagcuggccgcccccguggccggccagagcaacaucaucgaccccuggaucagaaugaacuucgugcaggcccccgccggcgaguucaccgugagccccagaaacgcccccggcgaggugcugaucgaccuggagcugggccccgagcugaaccccuaccugaaccaccuggccagaauguacaacggcuacgugggcggcauggagguggagguggugcuggccggcaacgccuucaccgccggcaagauccuguucgccgccgugccccccagcuuccccacccacggcaucagcgccgcccaggccaccaugcugccccacgugaucguggacgugagacagcuggagcccgugagacugccccugcccgacgugagaaacgugauguuccacuucugccaggagaacaaggagcccagaaugagaaucguggccauccuguacaccccccugagagccaacggcgccggcgacgacguguucaccgugagcugcagagugcugaccagacccagccccgacuucgacuucaucuuccuggugccccccagcguggagagcaagcugaagcaguucacccugcccaaccugcagcccaacgagaugaccaacagcagauuccccaccggcaucacccagcuguacaccagccccaacaccaaccugguggugcaguuccagaacggcagaugccugcuggacggcacccugcugggcaccacccccgugagagccgccgacaucugcagcuucagaggcgugaccagcaccgagguggacgccaccgacagccccagaguggccggcagccacagaaucauggugcagcugagagagcccgacggcgaggaguucagccccaccggccccaaccccgcccccgugggcacccccgacuuccaggccgccaucuucggcacccugagccagagaaacaccggcggcgccggccagaacagcaacagagcccacuucgccuacuucuacaccagaaaccccaccuucgcccccggcaucggcaccgugguguucagcuucgacaccaccgacuuccagaacagacagcccaccaaguucagccccagcggcguguucgacgacgacagcagcgagcccuucaaccaguucagccugcccuacuacaacggcagccugggcgccguggacgccggcaagcuggccccccccguggcccccaacuaccccggcgagcagauccuguacuucagaggcagcgugcccuucaagggcggcuacggcgagggcgagaucgacagccugcugccccaggaguggaucacccacuucuacgccgagcaggcccccacccagggcgacgccgcccugcugagauacuacaaccccgacaccggcagagugcuguucgagugcaagcugcacagagagggcuucaucaccaucaacuacaccggcagcaacgcccuggccgugcccgugaacggcguguucagauucgagggcugggugaacaaguucuacacccugacccccauguga

SEQ ID NO: 24514 - RNA, 1629 nt, Artificial Sequence
  derived and/or modified sequence opt4 from VP1__Norovirus_and/or_Norovirus-like__GQ856474
augagaauggccagcagcgacgcccccgugagcggcaccgacggcgccgccggccuggugcccgagagccagcaggaggugcugccccuggagcccguggccggcgugcagcuggccgcccccguggccggccagagcaacaucaucgaccccuggaucagaaugaacuucgugcaggcccccgccggcgaguucaccgugagccccagagacgcccccggcgaggugcugaucgaccuggagcugggccccgagcugaaccccuaccugaaccaccuggccagaauguacaacggcuacgugggcggcauggagguggagguggugcuggccggcaacgccuucaccgccggcaagauccuguucgccgccgugccccccagcuuccccacccacggcaucagcgccgcccaggccaccaugcugccccacgugaucguggacgugagacagcuggagcccgugagacugccccugcccgacgugagaaacgugauguuccacuucugccaggagaacaaggagcccagaaugagaaucguggccauccuguacaccccccugagagccaacggcgccggcgacgacguguucaccgugagcugcagagugcugaccagacccagccccgacuucgacuucaucuuccuggugcugcccagcguggagagcaagcugaagcaguucacccugcccaaccugcagcccaacgagaugaccaacagcagauuccccaccggcaucauccagcuguacaccagccccaacaccaaccugguggugcaguuccagaacggcagaugccugcuggacggcacccugcugggcaccacccccgugagagccgccgacaucugcagcuucagaggcgugaccagcaccgagguggacgccaccgacagccccagaguggccggcagccacagaaucauggugcagcugaaggagcccgacggcgaggaguucagccccaccggccccaaccccgcccccgugggcacccccgacuuccaggccgccaucuucggcacccugagccagagaaacaccggcggcgccggccagaacagcaacagagccagauucgccuacuucuacaccagaaaccccaccuucgcccccggcaucggcaccgugguguucagcuucgacaccaccgacuuccagaacagacagcccaccaaguucagccccagcggcguguucgacgacgacagcagcgagcccuucaaccaguucagccugcccuacuacaacggcagccugggcgccguggacgccggcaagcuggccccccccguggcccccaacuaccccggcgagcagauccuguacuucagaggcaacauccccuucaagggcggcuacggcgagggcgagaucgacagccugcugccccaggaguggaucacccacuucuacgccgagcaggcccccacccagggcgacgccgcccugcugagauacuacaaccccgacaccggcagagugcuguucgagugcaagcugcacagagagggcuucaucaccaucaacuacaccggcagcaacgcccuggccgugcccgugaacggcguguucagauucgagggcugggugaacaaguucuacacccugacccccauguga

SEQ ID NO: 24515 - RNA, 1629 nt, Artificial Sequence
  derived and/or modified sequence opt4 from VP1__Norovirus_and/or_Norovirus-like__LC145787
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacgugcccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacgugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24516 - RNA, 1629 nt, Artificial Sequence
  derived and/or modified sequence opt4 from VP1__Norovirus_and/or_Norovirus-like__AB629946
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauucaccgugagcaucgaccagauguacaccagccugaacgaggugaucagcgugcagugccagaacggcagaugcacccuggacggcgagcugagaggcaccacccagcugcaggugagcggcaucugcgccuucaagggcgaggugaccgcccacgugcacgacaacgaccaccuguacaacgugaccaucaccaaccugaacggcagccccuucgaccccagcgaggacgugcccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacgugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24517 - RNA, 1629 nt, Artificial Sequence
  derived and/or modified sequence opt4 from VP1__Norovirus_and/or_Norovirus-like__KT962983
augaagauggccagcaacgacgccgcccccagcaccgacggcgccgccggccuggugcccgagagcaacaccgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagagugcaguga

SEQ ID NO: 24518 - RNA, 1626 nt, Artificial Sequence
  derived and/or modified sequence opt4 from VP1__Norovirus_and/or_Norovirus-like__AB083780
augaagauggccagcaacgacgccgcccccagcaacgacggcgccgccggccuggugcccgagaucaacaccgaggugauggcccuggagcccguggccggcggcgccaucgccgccccccugaccggccagaccaacaucaucgaccccuggaucagaaacaacuucgugcaggcccccaacggcgaguucaccaucagccccagaaacagccccggcgagauccugcugaacauggagcugggccccgagcugaaccccuuccuggcccaccugagcagaauguacaacggcuucgccggcggcauggaggugcaggugcugauggccggcaacgccuucaccgccggcaaggugaucuucgccgccgugcccccccacuuccccguggagaaccugagccccccccagaucaccauguucccccacaucaucaucgacgugagaacccuggagcccgugcugcugcccaugcccgacgugagaaaccaguucuuccacuacaaccaggugaacgagcccagaaugagacugguggccaugcuguacaccccccugagaagcaacggcagcaccgaggacguguucaccgugagcugcagagugcugaccagacccagccccgacuucgaguucaacuaccuggugccccccaccguggagagcagaaccaagcccuucacccugcccgugcugaccaucggcgagaugaccaacagcagauuccccgcccccaucgacaugcuguacaccagccccaacggcaacgugguggugcagccccagaacggcagaugcacccuggacggcgagcugcagggcagcacccagcuggugcccgccaacgugugcgccuucagaggcaagaucaccgccagaaucguggaccaggccgcccaccaguggcacaugcagaucgacaaccccaacggcacccuguucgaccccaccgaggacgugcccgccccccugggcacccccgacuucaaggccaagaucuucggcgugaucagccagagaaacgacuacaacgacggcagccagggccccgccaacagagcccacgacgccguggugcccaccaccagcgccaaguucacccccaagcugggcagcauccuggugggcaccugggagaacaacgacaucgagacccagcccagcaaguucacccccgugggccugcuggagaugaacgacuucaaccaguggagccugcccaacuacagcggcgcccugacccugaacaugggccuggcccccgccguguuccccaccuuccccggcgagcagauccuguucuucagaagcuucaucccccugaagggcggccacggcaaccccgccaucgacugccugcugccccaggaguggauccagcacuucuaccaggagagcgcccccagccagaccagcguggcccugaucagauacgugaaccccgacaccggcagagugcuguucgagggcaagcugcacagacagggcuucaucaccaucgccaagagcggcgacggccccaucguggugccccccaacggcuacuucagauucgacagcugggugaaccaguucuacagccuggcccccaugggcaacggcaacggcagaagaagaauccaguga

SEQ ID NO: 24519 - RNA, 1626 nt, Artificial Sequence
  derived and/or modified sequence opt4 from VP1__Norovirus_and/or_Norovirus-like__KX987840
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaauggccgaccugcccgugauccagcccagacugugcacccacgccagauggcccgcccccguguacggccugcugguggaccccagccugcccagcaacccccaguggcagaacggcagagugcacguggacggcacccugcugggcaccacccccaucagcggcagcugggugagcugcuucgccgccgaggccgccuacgaguaccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagcccggcgacaagcugaaggugaccaccuucgagaugauccugggccccaccaccaacguggaccaggcccccuaccagggcagaguguacgccagcgugaccgccgccgccacccugaaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucaucagcugguucgccagcaacgccuucaccgugcagagcgaggcccugcugcugagauacagaaacacccugaccggccagcugcuguucgagugcaagcuguacagcgagggcuacaucgcccugagcuaccccggcagcggcccccugaccuuccccaccgacggcuucuucgagguggugagcugggugcccagacuguaccagcuggccagcgugggcagccuggccaccggcagaacccugaagcaguga

SEQ ID NO: 24520 - RNA, 1626 nt, Artificial Sequence
  derived and/or modified sequence opt4 from VP1__Norovirus_and/or_Norovirus-like__KR349276
augagaaugagcgacggcgccgcccccaaggccaacggcagcgaggccaacggccaggaccuggugcccaccgccguggagcaggccgugcccauccagcccguggccggcgccagccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugggcagcaacccccaguggcagaacggcagagugcacguggacggcacccugcugggcaccacccccaucagcggcagcugggugagccuguucgccgccgaggccgccuacgaguuccagagcggcaccggcgagguggccaccuucacccugaucgagcaggacggcagcgccuacgugcccggcgagagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagaguguacgccagccugaccaccgccgccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagaucgacagcagcgacgccgccgccgaggccaucgacugcgcccugccccaggaguucgugagcugguucgccagcaacgccuucaccgugcagagcgaggcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcuggggccccagacuguaccagcuggccagcgugggcagccuggccaccggcagaacccugaagcaguga

SEQ ID NO: 24521 - RNA, 1626 nt, Artificial Sequence
  derived and/or modified sequence opt4 from VP1__Norovirus_and/or_Norovirus-like__KM102449
augagaaugagcgacggcgccgcccccaaggccaacggcagcgaggccaucggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagagcccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccguguacagaaugguggaccugcccgugcugcagcccagacugugcacccacgccagauggcccgcccccguguacggccugcugguggaccccagccugcccagcaacccccaguggcagaacggcagagugcacgugaacggcacccugcugggcaccacccccgugagcggcagcugggugagcugcuucgccgccgaggccgccuacgaguuccagagcggcaccggcgagguggccaccuucaccaugaucgagcaggacggcagcgccuacgugcccggcgacagagccgccccccugggcuaccccgacuucagcggccagcuggagaucgaggugcagaccgagaccaccaagagcggcgacaagcugaaggugaccaccuucgagaugauccugggccccaccaccaacgccgaccaggcccccuaccagggcaagguguacgccagccuggccgccgccgccccccuggaccugguggacggcagagugagagccgugcccagaagcguguacuucuuccaggacgugcugcccgaguacaacgacggccugcuggugccccuggcccccccccugggccccuuccugcccggcgaggugcugcugagauucagaaccuacgugagacagcuggacaccgccgacgccgccgcccagcccaucgacugcgcccugccccaggaguucaucagcugguucgccagcaacagcuucaccgugcagagcgaggcccugcugaucagauacagaaacacccugaccggccagcugcuguucgaggccaagcuguacagcgagggcuacaucgccgugagcuacagcggcagcggcccccugaccuuccccaccgacggcuucuucgagguggugagcugggugcccagacuguuccagcuggccagcgugggcagccuggccaccggcagaacccugaagcaguga

SEQ ID NO: 24522 - RNA, 1626 nt, Artificial Sequence
  derived and/or modified sequence opt4 from VP1__Norovirus_and/or_Norovirus-like__KC792553
augagaaugagcgacggcgccgcccccaaggccaacggcagcgaggccagcggccaggaccuggugcccaccgccguggagcaggccgugcccauccagcccguggccggcgccgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccguguacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaucggccagguggccaccuucaccaugaucgagcaggacggcagcgccuacgugcccggcgacagagccgccccccugggcuaccccgacuacagcggccagcuggagaucgaggugcagaccgagaccaccaaggccggcgacaagcugaaggugaccaccuucgagaugauccugggccccaccaccaacgccgaccaggcccccuaccagggcagagccuacgccagccugaccgccgccgccagccuggaccugguggacggcagagugagagccgugcccagaagcaucuacagcuuccaggacgugcugcccgaguacaacgacggccugcuggugccccuggcccccccccugggccccuuccugcccggcgaggugcugcugagauucagaaccuacaugagacagcuggacaccgccgacgccgccgcccagcccaucgacugcgcccugccccaggaguucgugagcugguucgccagcaacagcuucaccgugcagagcgacgcccugcuggugagauacagaaacacccugaccggccagcugcuguucgaggccaagcuguacagcgagggcuacaucgccgugagcuacagcggcagcggcccccugaccuuccccgccgacggcaucuucgagguggugagcugggugcccagacuguuccagcuggccagcgugggcagccuggccaccggcagaacccugaagcaguga

SEQ ID NO: 24523 - RNA, 1626 nt, Artificial Sequence
  derived and/or modified sequence opt4 from VP1__Norovirus_and/or_Norovirus-like__AB809991
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaguguga

SEQ ID NO: 24524 - RNA, 1626 nt, Artificial Sequence
  derived and/or modified sequence opt4 from VP1__Norovirus_and/or_Norovirus-like__AB809990
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaguguga

SEQ ID NO: 24525 - RNA, 1626 nt, Artificial Sequence
  derived and/or modified sequence opt4 from VP1__Norovirus_and/or_Norovirus-like__AB809977
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagagaaccggcgaggccaagaacgccaagggcaucuacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaguguga

SEQ ID NO: 24526 - RNA, 1626 nt, Artificial Sequence
  derived and/or modified sequence opt4 from VP1__Norovirus_and/or_Norovirus-like__AB809987
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugauccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagaguguga

SEQ ID NO: 24527 - RNA, 1626 nt, Artificial Sequence
  derived and/or modified sequence opt4 from VP1__Norovirus_and/or_Norovirus-like__AJ844469
augaugauggccagcaaggacgcccccagcaacauggacggcaccagcggcgccggccagcuggugcccgaggccaacaccgccgaccccaucccccuggagcccguggugggcgccgccaccgccgccgccaccgccggccaggugaacaugaucgaccccuggaucaugaacaacuucgugcagagccccgagggcgaguucaccaucagccccaacaacacccccggcgacauccuguucgaccugcagcugggcccccaccugaaccccuuccugcagcaccugagccagauguacaacggcugggugggcaacaugagagugagaauccugcuggccggcaacgccuucagcgccggcaagaucaucaucugcugcgugccccccggcuucaccgcccagaacaucagcaucgcccaggccaccauguucccccacgugaucgccgacgugagagugcuggagcccaucgagaucccccuggacgacgugagaaacgugcuguuccacaccaacgagaacaagcccaccaugagacugcugugcaugcuguacaccccccugagagccggcggcgccagcgccggcaccgaccccuucgugaucgccggcagagugcugaccugccccagccccgacuucaacuuccuguuccuggugccccccagcguggagcagaagaccagacagcugaccgugcccaacaucccccugaacaaccugagcaacagcagagugcccgccaugaucagcaagauggccaucagcagcgacgccaaccagguggugcaguuccagaacggcagaugcaccaccgacggccagcugcugggcaccacccccaucagcgccagccagguggccagaaucagaggcaagguguucagcaccagcagcggcaagggccugaaccugagcgagcuggacggcagccccuaccacgccuucgagagccccgcccccgugggcuuccccgaccugggcuacugcgacuggcacgugagcagcuucaaggccgaccacaacagcagcagcgaccccaucagcagacuggacaucaagcagggcgccagcuucgccccccaccugggcagcaucgaguacaccaccagccagaaccccgacggcgaccagcugggcacccugaccuggaucagcagccccagcgacgacacccccggccacggcaccaucaaccuguggaagauccccagcuacggcagcaccgugaccgagagcgugcaccuggccccccccaucuacccccccggcuucggcgagacccugguguacuucaugagcgacuuccccaucggccacaccaacagcaacauggcccaggugcccugcacccugccccaggaguucguggcccacuucgugaacgagcaggcccccgugagaggcgacgccgcccugcugcacuacguggaccccgacacccacagaaaccugggcgaguucaagcuguaccccgagggcuacaucaccugcgugcccaacaccggcggcggcggcccccagagccugcccaucaacggcguguucaucuucagcagcugggugagcagauacuaccagcugaagcccgugggcaccgccggccccgccagaagacuguga

SEQ ID NO: 24528 - RNA, 1626 nt, Artificial Sequence
  derived and/or modified sequence opt4 from VP1__Norovirus_and/or_Norovirus-like__AY675555
augaagauggccagcaaggacgcccccagcaacauggacggcaccagcggcgccggccagcuggugcccgaggccaacaccgccgaccccaucccccuggagcccguggugggcgccgccaccgccgccgccaccgccggccaggugaacaugaucgaccccuggaucaugaacaacuucgugcagagccccgagggcgaguucaccaucagccccaacaacacccccggcgacauccuguucgaccugcagcugggcccccaccugaaccccuuccugcagcaccugagccagauguacaacggcugggugggcaacaugagagugagaauccugcuggccggcaacgccuucagcgccggcaagaucaucaucugcugcgugccccccggcuucaccgcccagaacaucagcaucgcccaggccaccauguucccccacgugaucgccgacgugagagugcuggagcccaucgagaucccccuggacgacgugagaaacgugcuguuccacaccaacgagaacagacccaccaugagacugcugugcaugcuguacaccccccugagagccggcggcgccagcgccggcaccgaccccuucgugaucgccggcagagugcugaccugccccagccccgacuucaacuuccuguuccuggugccccccagcguggagcagaagaccagacagcugaccgugcccaacaucccccugaacaaccugagcaacagcagcgugcccgccaugaucaacaagauggccaucagcagcgacgccaaccagguggugcaguuccagaacggcagaugcaccaccgacggccagcugcugggcaccacccccaucagcgccagccagguggccagaaucagaggcaagguguucagcaccagcagcggcaagggccugaaccugagcgagcuggacggcagccccuaccacgccuucgagagccccgcccccgugggcuuccccgaccugggccacugcgacuggcacgugagcagcuucaaggccgaccagaacagcagcggcgaccccaucagcagacuggacaucaagcagggcgccagcuucgccccccaccugggcagcaucgaguacaccaccagccagaaccccgacggcggccagcugggcacccugaccuggaucagcagccccagcgacgacacccccggccacggcaccaucaaccuguggaagauccccagcuacggcagcaccgugaccgagagcgugcaccuggccccccccaucuacccccccggcuucggcgagacccuggugaaccugaugagcaacuuccccaucggccacaccaacagcaacauggcccaggugcccugcacccugccccaggaguucguggcccacuucgugaacgagcaggcccccgugagaggcgacgccgcccugcugcacuacguggaccccgacacccacagaaaccugggcgaguucaagcuguaccccgagggcuacaucaccugcgugcccaacaccggcggcggcggcccccagagccugcccaccaacggcguguucaucuucagcagcugggugagcagauacuaccagcuggagcccgugggcaccgccggccccgccagaagacuguga

SEQ ID NO: 24529 - RNA, 1626 nt, Artificial Sequence
  derived and/or modified sequence opt4 from VP1__Norovirus_and/or_Norovirus-like__EU085479
augaagauggccagcagcgacgccacccccagcaacgacggcgccgccggccuggugcccgagaucaacaacgaggccauggcccuggaccccguggccggcgccgccaucgccgccccccugaccggccagcagaacaucaucgaccccuggaucaugaacaacuucgugcaggcccccggcggcgaguucaccgugagccccagaaacagccccggcgaggugcugcugaaccuggagcugggccccgagaucaaccccuaccuggcccaccuggccagaauguacaacggcuacgccggcggcuucgaggugcagguggugcuggccggcaacgccuucaccgccggcaagaucaucuucgccgccaucccccccaacuuccccaucgacaaccugagcgccgcccagaucaccaugugcccccacgugaucguggacgugagacagcuggagcccgugaaccugcccaugcccgacgugagaaacaacuucuuccacuacaaccagggcagcgacagcagacugagacugaucgccaugcuguacaccccccugagagccaacaacagcggcgacgacguguucaccgugagcugcagagugcugaccagacccagccccgacuucagcuucaacuuccuggugccccccaccguggagagcaagaccaagcccuucacccugcccauccugaccaucagcgagaugagcaacagcagauuccccgugcccaucgacagccugcacaccagccccaccgagaacaucguggugcagugccagaacggcagagugacccuggacggcgagcugaugggcaccacccagcugcugcccagccagaucugcgccuucagaggcgugcugaccagaagcaccagcagaaccagcgaccaggccgacaccgccacccccagacuguucaacuacuacuggcacauccagcuggacaaccugaacggcacccccuacgaccccgccgaggacauccccggcccccugggcacccccgacuucagaggcaagguguucggcguggccagccagagaaaccccgacagcaccaccagagcccacgaggccaagguggacaccaccgccggcagauucacccccaagcugggcagccuggagaucagcaccgagagcagcgacuucgaccagaaccagcccaccagauucacccccgugggcaucggcguggaccacgagaccgacuuccagcaguggagccugcccgacuacagcggccaguucacccacaacaugaaccuggcccccgccguggcccccaacuuccccggcgagcagcugcuguucuucagaagccagcugcccagcagcggcggcagaagcaacggcauccuggacugccuggugccccaggagugggugcagcacuucuaccaggagagcgcccccgcccagacccagguggcccuggugagauacgugaaccccgacaccggcagagugcuguucgaggccaagcugcacaagcugggcuucaugaccaucgccaagaacggcgacagccccaucaccgugccccccaacggcuacuucagauucgagagcugggugaaccccuucuacacccuggcccccaugggcagcggcuga

SEQ ID NO: 24530 - RNA, 1626 nt, Artificial Sequence
  derived and/or modified sequence opt4 from VP1__Norovirus_and/or_Norovirus-like__AF542090
auggccagcaaggacgcccccgugagcggcaccgacggcgccgccggccuggugcccgagagccagcaggaggugcugccccuggagcccguggccggcgugcagcuggccgcccccguggccggccagagcaacaucaucgaccccuggaucagaaugaacuucgugcaggcccccgccggcgaguucaccgugagccccagaaacgcccccggcgaggugcugaucgaccuggagcugggccccgagcugaaccccuaccugaaccaccuggccagaauguacaacggcuacgugggcggcauggagguggagguggugcuggccggcaacgccuucaccgccggcaaggugcuguucgccgccgugccccccagcuuccccacccacggcaucaccgccgcccaggccaccaugcugccccacgugaucguggacgugagacagcuggagcccgugagacugccccugcccgacgugagaaacgugauguuccacuucugccaggagaacaaggagcccagaaugagaaucguggccauccuguacaccccccugagagccaacggcgccggcgacgacguguucaccgugagcugcagagugcugaccagacccagccccgacuucgacuucaucuuccuggugccccccagcguggagagcaagcugaagcaguucacccugcccaaccugcagcccaacgagaugaccaacagcagauuccccaccagcgugacccagcuguacaccagccccaacaccaaccugguggugcaguuccagaacggcagaugccagcuggacggcacccugcugggcaccacccccgugagagccgccgacaucugcagcuucagaggcaucaccagcgccgagguggacaccaccgacagcagcagaguggccggcagccacagagugauggugcagcugaaggagcccgacggcgaggaguucagccccaccggccccaaccccgcccccgugggcacccccgacuuccaggccgccaucuucggcacccugagccagagaaacaacaccggcggcagcggccagaacagcaacagaagccacuucgccuacuucuacaccagaaaccccaccuucgcccccggcaucggcaccgugguguucagcuucgacaccaccgacuuccagaacagacagcccaccaaguucagccccagcggcguguacgacgacgacagcagcgagcccuucaaccaguucagccugcccuacuacaacggcagccugggcgccguggacgccggcaagcuggccccccccguggcccccaacuaccccggcgagcagauccuguacuucagaggcaacauccccuucaagggcggcuacggcggcggcgagaucgacugccugcugccccaggaguggaucacccaccuguacgccgagcaggcccccacccagggcgacgccgcccugcugagauacuacaaccccgacaccggcagagugcuguucgagugcaagcugcacagagagggcuucaucaccaucaacuacaccggcagcaacgcccuggccgugcccgugaacggcguguucagauucgagggcugggugaacaaguucuacacccugacccccauguga

SEQ ID NO: 24531 - RNA, 1623 nt, Artificial Sequence
  derived and/or modified sequence opt4 from VP1__Norovirus_and/or_Norovirus-like__KM386680
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccccccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 24532 - RNA, 1623 nt, Artificial Sequence
  derived and/or modified sequence opt4 from VP1__Norovirus_and/or_Norovirus-like__AF397156
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagcugcaggccugcaacaucugcagcaucagaggcaaggugaccggccaggugcccaacgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgaccccuggggcaaccaguucuacagccuggcccccaugggcaccggcaacggcagaagaagauuccaguga

SEQ ID NO: 24533 - RNA, 1623 nt, Artificial Sequence
  derived and/or modified sequence opt4 from VP1__Norovirus_and/or_Norovirus-like__AF414422
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcgagcugcugggcaccacccagccccaggccugcaacaucugcagcaucagaggcaaggugaccggccaggugcccaacgagcagcacaccuggaaccuggagaucaccaaccugaacggcacccaguucgaccccaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucggcuucgacagcugggugaaccaguucuacagccuggcccccaugggcaccggcaacggcagaagaagauuccaguga

SEQ ID NO: 24534 - RNA, 1623 nt, Artificial Sequence
  derived and/or modified sequence opt4 from VP1__Norovirus_and/or_Norovirus-like__AF414423
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccagaaacagccccggcgagauccuggugaaccuggagagcggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccccuuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuggacggcggccugcugggcaccacccagcugcaggccugcaacaucugcagcaucagaggcaaggugaccggccaggugcccagcgagcagcacauguggaaccuggagaucaccaaccugaacggcacccaguucgaccccaccgacgacgugcccgccccccugggcgugcccgacuucgccggcgagguguucggcgugcugagccagagaaacagaggcgagagcaacagcgccaacagagcccacgacgccgugguggccaccuacagcgacaaguacacccccaagcugggccuggugcagaucggcaccuggaacaccaacgacguggagaaccagcccaccaaguucacccccaucggccugaacggcguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 24535 - RNA, 1623 nt, Artificial Sequence
  derived and/or modified sequence opt4 from VP1__Norovirus_and/or_Norovirus-like__GQ856476
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccugagcagaauguacaacggcuacgccggcggcguggaggugcaggugcugcuggccggcaacgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccuggccgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgugcuggccaccuacagcgccaaguacacccccaagcugggcagcgugcagaucggcaccugggacaccgaggaccugcuggagagacagcccgugaaguucacccccgugggccugaacgagaucggccaggacaagcacuucgaccagugggugcugcccaacuacagcggcgcccugggccugaacaugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaagggcggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 24536 - RNA, 1623 nt, Artificial Sequence
  derived and/or modified sequence opt4 from VP1__Norovirus_and/or_Norovirus-like__AJ277607
augaagauggccagcaacgacgccacccccagcaacgacggcgccgccggccuggugcccgagagcaacaacgaggccauggcccuggagcccguggugggcgccagccuggccgcccccgugaccggccagaccaacaucaucgaccccuggaucagaaccaacuucgugcaggcccccaacggcgaguucaccgugagccccaagaacagccccggcgagauccuggugaaccuggagcugggccccgagcugaaccccuaccuggcccaccuggccagaauguacaacggcuacgccggcggcauggaggugcaggugaugcuggccggcaacgccuucaccgccggcaagaucaucuucgccgccgugccccccuacuuccccguggagaaccugagccccagccagaucaccauguucccccacgugaucaucgacgugagaacccuggagcccgugcugcugcccaugcccgacgugagaagcacccuguuccacuucaaccagaaggacgagcccaagaugagacugguggccaugcuguacaccccccugagaagcaacggcagcggcgacgacguguucaccgugagcugcagaauccugaccagacccagccccgaguucgacuucaccuaccuggugccccccaccguggagagcaagaccaagcccuucacccugcccgugcugacccugggcgagcugagcaacagcagauucccccugagcaucgacgagauggugaccagccccaacgagagcaucguggugcagccccagaacggcagagugacccuguacggcgagcugcugggcaccgcccagcugcaggccugcaacaucugcagcaucagaggcaaggugaccggccaguuccccaacgagcagaacauguggaaccuggagaucaccaaccugaacggcacccaguucgaccugaccgacgacgugcccgccccccugggcgugcccgacuucgccggcgagguguucggcgugcugagccagagaaacagaggcgagagcaaccccgccaacagagcccacgacgccgugguggccaccuacagcgacaaguacacccccaagcugggccuggugcagaucggcaccuggaacaccaacgacguggagaaccagcccaccaaguucacccccaucggccugaacgagguggccaacggccacagauucgagcaguggacccugcccagauacagcggcgcccugacccugaacaugaaccuggcccccgccguggccccccuguuccccggcgagagacugcuguucuucagaagcuacgugccccugaagggcggcuucggcaaccccgccaucgacugccuggugccccaggagugggugcagcacuucuaccaggagagcgcccccagccugggcgacguggcccuggugagauacgugaaccccgacaccggcagagugcuguucgaggccaagcugcacaagggcggcuuccugaccgugagcagcaccagcaccggccccgugguggugcccgccaacggcuacuucagauucgacagcugggugaaccaguucuacagccuggcccccaugggcaccggcaacggcagaagaagauuccaguga

SEQ ID NO: 24537 - RNA, 1623 nt, Artificial Sequence
  derived and/or modified sequence opt4 from VP1__Norovirus_and/or_Norovirus-like__AY772730
augaagauggccagcaacgacgccgcccccagcaacgacggcgccgccggccuggugcccgaggugaacaacgagaccauggcccuggagcccguggccggcgccagcaucgccgccccccugaccggccagaacaacgugaucgaccccuggaucagacugaacuucgugcaggcccccaacggcgaguucaccgugagccccagaaacagccccggcgagauccugcugaaccuggagcugggccccgagcugaaccccuaccuggcccaccuggccagaauguacaacggcuacgccggcggcguggaggugcaggugcugcuggccggcagcgccuucaccgccggcaagcugguguucgccgccauccccccccacuuccccguggacaaccugagccccggccagaucaccauguucccccacgugaucaucgacgugagaacccuggagcccgugcugcugccccugcccgacgugagaaacaacuucuuccacuacaaccagcagagcgaccagagaaugagacugguggccaugcuguacaccccccugagaagcaacggcagcggcgacgacguguucaccgugagcugcagagugcugaccagacccagccccgacuucgacuucaacuaccuggugccccccaccguggagagcaagaccaagcccuucagcgugcccgugcugacccugaacgagcugaccaacagcagauuccccgugcccaucgacgccauguacaccagccccaacgacagcaucguggugcagccccagaacggcagagccaccaucgacggcgagcugcugggcaccacccagcugauccccagcggcaucugcagcuucagaggcaagaucaccacccaccugagcgacgacagacaccuguggaacauccaggugagcaaccugaacggcacccccuucgaccccaccgacgacgugcccgccccccugggcaugcccgacuucagcggccagaucuucggcguggugagccagagagacaccggcaccaaccccgccaacagagcccacgacgccgcccuggccaccuacagcgccaaguacacccccaagcugggcagcgugcagaucggcgccugggacaccgaggaccugcuggagagacagcccgugaaguucagccccgugggccugagcgagaucggccaggacaagcacuucgaccagugggugcugcccaacuacagcggcgcccugggccugaacgugcaccuggcccccgccgugagcccccuguuccccggcgagagacugcuguucuucagaagcuacaucccccugaagggcggccacggcgaccccuucaucgacugccuggugccccaggaguggauccagcacuucuaccaggagagcgcccccgcccagagcagcguggcccugcugagauacgugaaccccgacaccggcagaacccuguucgaggccaagcugcacaaggagggcuucaucaccgugagcagcaccgagaacagacccgugaucgugccccccaacggcuacuucagauucgacagcugggugaaccaguucuacagccuggcccccaugggcaccggcaacggcagaagaagaaugcaguga

SEQ ID NO: 24538 - RNA, 1623 nt, Artificial Sequence
  derived and/or modified sequence opt4 from VP1__Norovirus_and/or_Norovirus-like__KT315718
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccgacagcaccagagcccagcaggccagcgugagcaccuacagcccccaguucgugcccaagcugggcagcgugaaccugagaaucagcaacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24539 - RNA, 1623 nt, Artificial Sequence
  derived and/or modified sequence opt4 from VP1__Norovirus_and/or_Norovirus-like__KT315708
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24540 - RNA, 1623 nt, Artificial Sequence
  derived and/or modified sequence opt4 from VP1__Norovirus_and/or_Norovirus-like__KT315697
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagagcccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24541 - RNA, 1623 nt, Artificial Sequence
  derived and/or modified sequence opt4 from VP1__Norovirus_and/or_Norovirus-like__KT315689
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccgugagccacagcggcgacuacccccugguggugcccgccaacggccacuucagauucgacagcugggugaaccaguucuacagccuggcccccaugggcaccggcaacggcagaagaagagcccaguga

SEQ ID NO: 24542 - RNA, 1623 nt, Artificial Sequence
  derived and/or modified sequence opt4 from VP1__Norovirus_and/or_Norovirus-like__KX216805
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24543 - RNA, 1623 nt, Artificial Sequence
  derived and/or modified sequence opt4 from VP1__Norovirus_and/or_Norovirus-like__KU557859
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcgugaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24544 - RNA, 1623 nt, Artificial Sequence
  derived and/or modified sequence opt4 from VP1__Norovirus_and/or_Norovirus-like__KU557828
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccgacagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24545 - RNA, 1623 nt, Artificial Sequence
  derived and/or modified sequence opt4 from VP1__Norovirus_and/or_Norovirus-like__KT315692
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugagccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24546 - RNA, 1623 nt, Artificial Sequence
  derived and/or modified sequence opt4 from VP1__Norovirus_and/or_Norovirus-like__KX168437
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgaggugcugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24547 - RNA, 1623 nt, Artificial Sequence
  derived and/or modified sequence opt4 from VP1__Norovirus_and/or_Norovirus-like__KX168440
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggagugggugcagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24548 - RNA, 1623 nt, Artificial Sequence
  derived and/or modified sequence opt4 from VP1__Norovirus_and/or_Norovirus-like__KX216793
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcuggugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24549 - RNA, 1623 nt, Artificial Sequence
  derived and/or modified sequence opt4 from VP1__Norovirus_and/or_Norovirus-like__KU557881
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagccuggugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24550 - RNA, 1623 nt, Artificial Sequence
  derived and/or modified sequence opt4 from VP1__Norovirus_and/or_Norovirus-like__KY424350
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcaucaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24551 - RNA, 1623 nt, Artificial Sequence
  derived and/or modified sequence opt4 from VP1__Norovirus_and/or_Norovirus-like__KU557884
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcgccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24552 - RNA, 1623 nt, Artificial Sequence
  derived and/or modified sequence opt4 from VP1__Norovirus_and/or_Norovirus-like__KU561253
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccacaccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24553 - RNA, 1623 nt, Artificial Sequence
  derived and/or modified sequence opt4 from VP1__Norovirus_and/or_Norovirus-like__KP902588
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcagcgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24554 - RNA, 1623 nt, Artificial Sequence
  derived and/or modified sequence opt4 from VP1__Norovirus_and/or_Norovirus-like__KX168456
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacggcggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24555 - RNA, 1623 nt, Artificial Sequence
  derived and/or modified sequence opt4 from VP1__Norovirus_and/or_Norovirus-like__KX168444
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcagccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24556 - RNA, 1623 nt, Artificial Sequence
  derived and/or modified sequence opt4 from VP1__Norovirus_and/or_Norovirus-like__KX216806
augaagauggccaccaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24557 - RNA, 1623 nt, Artificial Sequence
  derived and/or modified sequence opt4 from VP1__Norovirus_and/or_Norovirus-like__KX216794
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugugcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24558 - RNA, 1623 nt, Artificial Sequence
  derived and/or modified sequence opt4 from VP1__Norovirus_and/or_Norovirus-like__KX420895
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgcccugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccagcuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24559 - RNA, 1623 nt, Artificial Sequence
  derived and/or modified sequence opt4 from VP1__Norovirus_and/or_Norovirus-like__KT591501
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggagauccaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24560 - RNA, 1623 nt, Artificial Sequence
  derived and/or modified sequence opt4 from VP1__Norovirus_and/or_Norovirus-like__KT315714
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccuggaucagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24561 - RNA, 1623 nt, Artificial Sequence
  derived and/or modified sequence opt4 from VP1__Norovirus_and/or_Norovirus-like__KT315673
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccaagaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24562 - RNA, 1623 nt, Artificial Sequence
  derived and/or modified sequence opt4 from VP1__Norovirus_and/or_Norovirus-like__KX216792
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcacaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaacuucagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24563 - RNA, 1623 nt, Artificial Sequence
  derived and/or modified sequence opt4 from VP1__Norovirus_and/or_Norovirus-like__KU953398
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaccgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24564 - RNA, 1623 nt, Artificial Sequence
  derived and/or modified sequence opt4 from VP1__Norovirus_and/or_Norovirus-like__KU557888
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcagcacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24565 - RNA, 1623 nt, Artificial Sequence
  derived and/or modified sequence opt4 from VP1__Norovirus_and/or_Norovirus-like__KU557808
augaagauggccagcaacgacguggcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggagugggugcagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24566 - RNA, 1623 nt, Artificial Sequence
  derived and/or modified sequence opt4 from VP1__Norovirus_and/or_Norovirus-like__KU557807
augaagauggccagcaacgacguggcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24567 - RNA, 1623 nt, Artificial Sequence
  derived and/or modified sequence opt4 from VP1__Norovirus_and/or_Norovirus-like__KX371111
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24568 - RNA, 1623 nt, Artificial Sequence
  derived and/or modified sequence opt4 from VP1__Norovirus_and/or_Norovirus-like__KX371110
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagcacgacagauggcacaugcagcugcagaaccugaacggcaccaccuacgaccccaccgacgacgugcccgccccccugggcacccccgacuucaagggcgugguguucggcauggugagccagagaaacgugggcaccgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24569 - RNA, 1623 nt, Artificial Sequence
  derived and/or modified sequence opt4 from VP1__Norovirus_and/or_Norovirus-like__KX134669
augaagauggccagcagcgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24570 - RNA, 1623 nt, Artificial Sequence
  derived and/or modified sequence opt4 from VP1__Norovirus_and/or_Norovirus-like__KU557871
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgcccugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24571 - RNA, 1623 nt, Artificial Sequence
  derived and/or modified sequence opt4 from VP1__Norovirus_and/or_Norovirus-like__KX371108
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggagauccaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24572 - RNA, 1623 nt, Artificial Sequence
  derived and/or modified sequence opt4 from VP1__Norovirus_and/or_Norovirus-like__KU557829
augaagauggccagcaacgacgccgcccccagcaacgacggcgccgccggccuggugcccgagggcaacaacgagacccugccccuggagcccguggccggcgccgccaucgccgcccccgugaccggccagaacaacaucaccgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccgacagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24573 - RNA, 1623 nt, Artificial Sequence
  derived and/or modified sequence opt4 from VP1__Norovirus_and/or_Norovirus-like__KX168452
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgcccccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24574 - RNA, 1623 nt, Artificial Sequence
  derived and/or modified sequence opt4 from VP1__Norovirus_and/or_Norovirus-like__KU953393
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcagcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24575 - RNA, 1623 nt, Artificial Sequence
  derived and/or modified sequence opt4 from VP1__Norovirus_and/or_Norovirus-like__KR052020
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagcccgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24576 - RNA, 1623 nt, Artificial Sequence
  derived and/or modified sequence opt4 from VP1__Norovirus_and/or_Norovirus-like__KT315687
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagagcaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24577 - RNA, 1623 nt, Artificial Sequence
  derived and/or modified sequence opt4 from VP1__Norovirus_and/or_Norovirus-like__KX356908
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugagcagcgacaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgaccacccccugguggugcccgccaacggccacuucagauucgacagcugggugaaccaguucuacagccuggcccccaugggcaccggcaacggcagaagaagagcccaguga

SEQ ID NO: 24578 - RNA, 1623 nt, Artificial Sequence
  derived and/or modified sequence opt4 from VP1__Norovirus_and/or_Norovirus-like__KX024652
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccaccccaccaaguucacccccgugggcgugaacgacgacaacgacggcccccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24579 - RNA, 1623 nt, Artificial Sequence
  derived and/or modified sequence opt4 from VP1__Norovirus_and/or_Norovirus-like__KT315706
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccaccagcgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24580 - RNA, 1623 nt, Artificial Sequence
  derived and/or modified sequence opt4 from VP1__Norovirus_and/or_Norovirus-like__KX134670
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccaugcccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24581 - RNA, 1623 nt, Artificial Sequence
  derived and/or modified sequence opt4 from VP1__Norovirus_and/or_Norovirus-like__KT780399
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcaccgugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24582 - RNA, 1623 nt, Artificial Sequence
  derived and/or modified sequence opt4 from VP1__Norovirus_and/or_Norovirus-like__KP902577
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcaccgugcugaccacccccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24583 - RNA, 1623 nt, Artificial Sequence
  derived and/or modified sequence opt4 from VP1__Norovirus_and/or_Norovirus-like__KU587628
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccuacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaacaagcccuucagccugcccaucuucacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccaccggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcaacgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24584 - RNA, 1623 nt, Artificial Sequence
  derived and/or modified sequence opt4 from VP1__Norovirus_and/or_Norovirus-like__AF414409
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccagcagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagaagccacgaggccaacaucaacaccggcggcgaccaguacgcccccaagcuggcccaggugaagaucuucagccagagccaggacuucgaggugcaccagcccaccguguucacccccgugggcguggccggcgacaccagccaccccuucagacaguggacccugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagaauccaguga

SEQ ID NO: 24585 - RNA, 1623 nt, Artificial Sequence
  derived and/or modified sequence opt4 from VP1__Norovirus_and/or_Norovirus-like__KT943504
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaccaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgagaucaccgccaagagcguggacgugagaagcuacagaauggacauggagaucaccaacaccgacggcacccccaucgaccccaccgaggacacccccggccccaucggcagccccgacuucagaggcauccuguucggcguggccagccagagaaacaagggcgagcagauccccgccaccagagcccacgaggccaacaucaacaccggcggcgaccaguacgcccccaagcuggcccaggugaaguucuucagcggcagccaggacuucgaggugcaccagcccaccguguucacccccgugggcguggccggcgacagcagccaccccuuccagcagugggcccugcccagauacggcggccaccugaccaacaacacccaccuggcccccgccguggccccccuguuccccggcgagcagauccuguucuucagaagccagauccccagcagcggcggccacgagaugggcuacauggacugccuggugccccaggagugggugcagcacuucuaccaggaggccgccaccgcccagagcgagguggcccugaucagauucgugaaccccgacaccggcagagugcuguucgaggccaagcugcacaagcagggcuucaucaccguggcccacaccggcgacaaccccaucgugaugccccccaacggccacuucagauucgaggccugggugaaccaguucuacagccuggcccccgugggcaccggcaacggcagaagaagaauccaguga

SEQ ID NO: 24586 - RNA, 1623 nt, Artificial Sequence
  derived and/or modified sequence opt4 from VP1__Norovirus_and/or_Norovirus-like__KT943505
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaccaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucaucuucgccgccaucccccccggcuuccccuacgagaaccugagccccagccagaucaccaugugcccccacgugaucaucgacgugagacagcuggagcccgugcugcugcccaugcccgacaucagaaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgagaucaccgccaagagcguggacgugagaagcuacagaauggacauggagaucaccaacaccgacggcacccccaucgaccccaccgaggacacccccggccccaucggcagccccgacuucagaggcauccuguucggcguggccagccagagaaacaagggcgagcagauccccgccaccagagcccacgaggccaacaucaacaccggcggcgaccaguacgcccccaagcuggcccaggugaaguucuucagcggcagccaggacuucgaggugcaccagcccaccguguucacccccgugggcguggccggcgacagcagccaccccuuccagcagugggcccugcccagauacggcggccaccugaccaacaacacccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucgugaaccccgacaccggcagagugcuguucgaggccaagcugcacaagcagggcuucaucaccguggcccacaccggcgacaaccccaucgugaugccccccaacggccacuucagauucgaggccugggugaaccaguucuacagccuggcccccgugggcaccggcaacggcagaagaagaauccaguga

SEQ ID NO: 24587 - RNA, 1623 nt, Artificial Sequence
  derived and/or modified sequence opt4 from VP1__Norovirus_and/or_Norovirus-like__KT962982
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacaagggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagcccaguga

SEQ ID NO: 24588 - RNA, 1623 nt, Artificial Sequence
  derived and/or modified sequence opt4 from VP1__Norovirus_and/or_Norovirus-like__KX079488
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagcccaguga

SEQ ID NO: 24589 - RNA, 1623 nt, Artificial Sequence
  derived and/or modified sequence opt4 from VP1__Norovirus_and/or_Norovirus-like__KR921938
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggaguggaucagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagcccaguga

SEQ ID NO: 24590 - RNA, 1623 nt, Artificial Sequence
  derived and/or modified sequence opt4 from VP1__Norovirus_and/or_Norovirus-like__KR921940
augaagauggccagcaacgacgccgcccccagcaacgacggcgccgccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacgugguggugcagccccagaacggcagaugcacccuggacggcgagcugcagggcaccacccagcugcugaccaccgccaucugcagcuacagaggcaccaccagcaaccccaccagcgacuacugggacgaccaccugcugcaccuggugcaccccaacggcgccaccuacgaccccaccgaggacgugcccgcccccuucggcacccaggacuucagaggcauccuguacggcgugcugacccagaacacccagaaccccagagacgaggugagcaacagcagaggcaucuacaucagcagcaccagcgacaaguucacccccaagcugggcaccaucggccugcaccaggugcagggcgacaccgccagcaaccagcagagcaaguucacccccgugggcaucgccgugaaccagaacacccccuucaagcagugggagcugcccaacuacagcggcgcccugacccugaacaccaaccuggcccccgccgugggccccaacuuccccggcgagcagauccuguucuucagaagcaacgugcccagcgugcagggcaaccaccccacccaggagaucgacugccugaucccccaggagugggugagccacuucuaccaggagagcgcccccagccagagcgacguggcccuggugagauacgugaaccccgacaccggcagaaccaccuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagcccaguga

SEQ ID NO: 24591 - RNA, 1623 nt, Artificial Sequence
  derived and/or modified sequence opt4 from VP1__Norovirus_and/or_Norovirus-like__DQ358209
augaagauggccagcaacgacgccgcccccagcaacgacggcgccgccggccuggugcccgagaucaacaacgaggugaugccccuggagcccguggccggcgccagccuggccacccccguggugggccagcagaacaucaucgaccccuggaucagaaacaacuucgugcaggcccccgccggcgaguucaccgugagccccagaaacagccccggcgagauccugcuggaccuggagcugggccccgagcugaaccccuaccuggcccaccuggccagaauguacaacggccacgccggcggcauggaggugcagaucgugcuggccggcaacgccuucaccgccggcaagaucguguucgccgccaucccccccggcuuccccuacgagaaccugagccccagccagaucaccaugugcccccacgugaucaucgacgugagacagcuggagcccgugcugcugcugaugcccgacaucaagaacaacuucuuccacuacaaccagggcaacgaccccaagcugagacugguggccaugcuguacaccccccugagagccaacaacagcggcgacgacguguucaccgugagcugcagagugcugaccaagcccagccccgacuucgaguucaccuuccuggugccccccaccguggagagcaagaccaagcaguucacccugcccauccugaagaucagcgagaugaccaacagcagauuccccgugcccguggagaugauguacaccgccagaaacgagaaccagguggugcagccccagaacggcagagugacccuggacggcgagcugcugggcaccaccccccugcuggccgugaacaucugcaaguucaagggcgaggugaucgccaagaacggcgacgugagaagcuacagaauggacauggagaucaccaacaccgacggcacccccaucgaccccaccgaggacacccccggccccaucggcagccccgacuuccagggcauccuguucggcguggccagccagagaaacaagaacgagcagaaccccgccaccagagcccaggaggugaacaucaacaccggcggcgaccaguacgcccccaagcuggcccaggugaaguucuucagcgagagccaggacuucgaggugcaccagcccaccguguucacccccgugggcguggccggcgaccccagccaccccuucagacaguggacccugcccagauacggcggccaccugaccaacaacauccaccuggcccccgccguggccccccuguuccccggcgagcagauccuguucuucagaagccagauccccagcagcggcggccacgagcugggcuacauggacugccuggugccccaggagugggugcagcacuucuaccaggaggccgccaccgcccagagcgagguggcccugaucagauucaucaaccccgacaccggcagagugcuguucgaggccaagcugcacaagcagggcuucaucaccguggcccacaccggcgacaaccccaucgugaugccccccaacggcuacuucagauucgaggccugggugaaccaguucuacagccuggcccccgugggcaccggcaacggcagaagaagagugcaguga

SEQ ID NO: 24592 - RNA, 1623 nt, Artificial Sequence
  derived and/or modified sequence opt4 from VP1__Norovirus_and/or_Norovirus-like__KP784694
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgacccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaagccacaaggccaccguguacaccggcagcgccgacuucgcccccaagcugggcagagugcaguucgagaccgacaccaacaacgacuucgagaccaaccagaacaccaaguucacccccgugggcgugauccagaacggcgagaccgcccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcagccacgaccuggugaucccccccaacggcuacuucagauucgacagcugggugaaccaguucuacacccuggcccccaugggcaacggcaccggcagaagaagagccaccuga

SEQ ID NO: 24593 - RNA, 1623 nt, Artificial Sequence
  derived and/or modified sequence opt4 from VP1__Norovirus_and/or_Norovirus-like__KX354064
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagagccauguga

SEQ ID NO: 24594 - RNA, 1623 nt, Artificial Sequence
  derived and/or modified sequence opt4 from VP1__Norovirus_and/or_Norovirus-like__LC177658
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagaguggccuga

SEQ ID NO: 24595 - RNA, 1623 nt, Artificial Sequence
  derived and/or modified sequence opt4 from VP1__Norovirus_and/or_Norovirus-like__KX514232
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagagccagcuga

SEQ ID NO: 24596 - RNA, 1623 nt, Artificial Sequence
  derived and/or modified sequence opt4 from VP1__Norovirus_and/or_Norovirus-like__LC145787
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacgugcccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacgugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24597 - RNA, 1623 nt, Artificial Sequence
  derived and/or modified sequence opt4 from VP1__Norovirus_and/or_Norovirus-like__KT962983
augaagauggccagcaacgacgccgcccccagcaccgacggcgccgccggccuggugcccgagagcaacaccgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacaucaccaucaccaaccugaacggcagccccuucgaccccagcgaggacauccccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24598 - RNA, 1623 nt, Artificial Sequence
  derived and/or modified sequence opt4 from VP1__Norovirus_and/or_Norovirus-like__AB629946
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugagccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauucaccgugagcaucgaccagauguacaccagccugaacgaggugaucagcgugcagugccagaacggcagaugcacccuggacggcgagcugagaggcaccacccagcugcaggugagcggcaucugcgccuucaagggcgaggugaccgcccacgugcacgacaacgaccaccuguacaacgugaccaucaccaaccugaacggcagccccuucgaccccagcgaggacgugcccgccccccugggcgugcccgacuuccagggcagaguguucggcaucaucagccagagagacaagcacaacagccccggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacgugccccugaagggcggcuacggcaaccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24599 - RNA, 1623 nt, Artificial Sequence
  derived and/or modified sequence opt4 from VP1__Norovirus_and/or_Norovirus-like__AB809993
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagaagauga

SEQ ID NO: 24600 - RNA, 1623 nt, Artificial Sequence
  derived and/or modified sequence opt4 from VP1__Norovirus_and/or_Norovirus-like__JQ743330
augaugauggccagcaaggacgccccccccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucagaagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggaggccgccuucgccccccaccugggcaccauccaggccgacggccugagcgacgugagcgugaacaccaacaugaucgccaagcugggcugggugagccccgugagcgacggccacagaggcagcguggaccccugggugauccccagauacggcagcacccugaccgaggccgcccagcuggccccccccaucuacccccccggcuucggcgaggccaucguguucuucaugagcgacuuccccaucgcccacggcgccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgagggcuucaugaccugcgugcccaacagcagcggcaccggcccccagacccugcccaucaacggcguguucgccuucgugagcugggugagcagauucuaccagcugaagcccgugggcaccgccggccccgccagaagacuguga

SEQ ID NO: 24601 - RNA, 1623 nt, Artificial Sequence
  derived and/or modified sequence opt4 from VP1__Norovirus_and/or_Norovirus-like__AF439267
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccgugggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacaagggcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24602 - RNA, 1623 nt, Artificial Sequence
  derived and/or modified sequence opt4 from VP1__Norovirus_and/or_Norovirus-like__EF547393
augaugauggccagcaagggcgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucguggcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcuggagugggugagccccgugagcgacggccacaagggcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24603 - RNA, 1623 nt, Artificial Sequence
  derived and/or modified sequence opt4 from VP1__Norovirus_and/or_Norovirus-like__AF145709
augaugauggccagcaaggacgccccccccaacauggacggcaccagcggcgccggccagcugauccccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaagaugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgcccuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacagaggcaacguggaccccugggugauccccagauacggcagcacccugaccgaggccgcccagcuggccccccccaucuacccccccggcuucggcgaggccaucguguucuucaugagcgacuucagcaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgagggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24604 - RNA, 1623 nt, Artificial Sequence
  derived and/or modified sequence opt4 from VP1__Norovirus_and/or_Norovirus-like__FJ711163
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacgugcuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacuucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugaugaucagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaucacccaguucgacaccggcgacgugaucaagcagaucaacgugaagcaggagagcgccuucgccccccaccugggcaccgugcaggccgacggccugagcgacgugagcgccaacaccaacaugaucgccaagcugggcugggugagccccgugagcgacggccacagaagcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24605 - RNA, 1623 nt, Artificial Sequence
  derived and/or modified sequence opt4 from VP1__Norovirus_and/or_Norovirus-like__FJ711164
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacgugcuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucguggcccagaacuucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccggcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugaugaucagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggagagcgccuucgccccccaccugggcaccgugcaggccgacggccugagcgacgugagcgccaacaccaacaugaucgccaagcugggcugggugagccccgugagcgacggccacagaagcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24606 - RNA, 1623 nt, Artificial Sequence
  derived and/or modified sequence opt4 from VP1__Norovirus_and/or_Norovirus-like__AF414405
augaugauggccagcaaggacgccccccccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggagagcgccuucgccccccaccugggcaccauccaggccggcggccugagcgacgugagcgugaacaccaacaugaucgccaagcugggcugggugagccccgugagcgacggccacagaggcaacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccuucaccaucccccaggaguucgugacccacuucgugaacgagcaggcccccaccagaggcgaggccgcccugcuguacuaccuggaccccgacacccacagaaaccugggcgaguucaagcuguaccccgagggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24607 - RNA, 1623 nt, Artificial Sequence
  derived and/or modified sequence opt4 from VP1__Norovirus_and/or_Norovirus-like__AB022679
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucaugggcuucggcgcccccgcccccgccggcuuccccgaccugggcagcugcgacuggcacaucgagaugagcaagauccccaacagcagcacccagaacaaccccaucgugaccaacagcgugaagcccaacagccagcaguucgugccccaccugagcagcaucacccuggacgagaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24608 - RNA, 1623 nt, Artificial Sequence
  derived and/or modified sequence opt4 from VP1__Norovirus_and/or_Norovirus-like__AF414403
augaugauggccagcaaggacgccccccccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagccugcuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagaguggcccuggacggccagcugcagggcaccacccccaccagcgccagccagcugugcaagaucagaggcagcguguuccacgccaacggcggcaacggcuacaaccccaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacagaggcaacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgagggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24609 - RNA, 1623 nt, Artificial Sequence
  derived and/or modified sequence opt4 from VP1__Norovirus_and/or_Norovirus-like__LC101821
augaugauggccagcaaggacgccgcccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgugggcuuccccgaccugggcagcugcgacuggcacaucgagaugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcggcagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24610 - RNA, 1623 nt, Artificial Sequence
  derived and/or modified sequence opt4 from VP1__Norovirus_and/or_Norovirus-like__AY038598
augaugauggccagcaaggacgccccccccaacauggacggcaccagcggcgccggccagcuggugcccgaggccaacaccgccgagcccaucagcauggagcccguggccggcgccgccaccgccgccgccaccgccggccaggugaacaugaucgaccccuggaucauggacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggaccccaucgaggugccccuggaggacgugggcaacgugcuguuccacaacaacggcgacacccccaccaugagacuggugugcaugcuguacaccccccugagagccagcggcagcagcagcggcaccgaccccuucgugaucgccggccacgugcugaccugccccagccccgacuucagcuuccuguuccugggcccccccaacguggagcagaagaccaagcccuucagcgugcccaaccugccccugaacacccugagcaacagcagagugcccagccugaucagaagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacacccugaccgagcuggacggcagccccuaccacgccuucgagagccccgcccccaucggcuuccccgaccugggcgagugcgacuggcacauggaggccagccccaccacccaguucgacaccggcgacgugaucaagcagaucaacgugaagcaggaggccgccuucgccccccaccugggcaccauccaggccgacggccugagcgacgugagcgugaacaccaacaugaucgccaagcugggcugggugagccccgccagcgacggccacagaggcaacguggaccccugggugauccccagauacggcagcacccugaccgaggccgcccagcuggccccccccaucuacccccccggcuucggcgaggccaucguguucuucaugagcgacuuccccaucgcccacggcgccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgagggcuucaugaccugcgugcccaacagcagcggcaccggcccccagacccugcccaucaacggcguguucguguucgugagcugggugagcagauucuaccagcugaagcccgugggcaccgccggccccgccagaagccuguga

SEQ ID NO: 24611 - RNA, 1623 nt, Artificial Sequence
  derived and/or modified sequence opt4 from VP1__Norovirus_and/or_Norovirus-like__KJ196292
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucguggcccagaacgugagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacaagggcgacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacagcagcggcaccggcccccagacccugcccaucaacggcguguucguguucgugagcugggugagcagauucuaccagcugaagcccgugggcaccgccggccccgccagaagacuguga

SEQ ID NO: 24612 - RNA, 1623 nt, Artificial Sequence
  derived and/or modified sequence opt4 from VP1__Norovirus_and/or_Norovirus-like__JQ743331
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgagaugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24613 - RNA, 1623 nt, Artificial Sequence
  derived and/or modified sequence opt4 from VP1__Norovirus_and/or_Norovirus-like__EF547394
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgaggugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24614 - RNA, 1623 nt, Artificial Sequence
  derived and/or modified sequence opt4 from VP1__Norovirus_and/or_Norovirus-like__AF394960
augaugauggccagcaaggacgccacccccagcgccgacggcgccaccggcgccggccagcuggugcccgaggugaacaccgccggccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgagaugagcaagauccccaacagcagcacccagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24615 - RNA, 1623 nt, Artificial Sequence
  derived and/or modified sequence opt4 from VP1__Norovirus_and/or_Norovirus-like__AJ277616
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccaagcuggacggcagccccuucauggccuucgccgcccccgcccccgccggcuuccccaaccugggcagcugcgacuggcacaucgagaugagcaagauccccaacagcagcacccagagcaaccccaucguggugaacagcgugaagcccaacagccagcaguucgugccccaccugagcagcaucacccuggacgagaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccugguguucaacgaggugaucguguacuucauggccugcaucagaggccccaaccagugcggcagccccaaccuggugcccugccugagcccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24616 - RNA, 1623 nt, Artificial Sequence
  derived and/or modified sequence opt4 from VP1__Norovirus_and/or_Norovirus-like__GQ413970
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24617 - RNA, 1623 nt, Artificial Sequence
  derived and/or modified sequence opt4 from VP1__Norovirus_and/or_Norovirus-like__KT732281
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgaggugagcaagauccccaacagcagcacccagggcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24618 - RNA, 1623 nt, Artificial Sequence
  derived and/or modified sequence opt4 from VP1__Norovirus_and/or_Norovirus-like__AF414404
augaugauggccagcaaggacgccacccccagcgccgacggcgccaccggcgccggccagcuggugcccgaggugaacaccgccgaccccauccccaucgaccccguggccggcagcagcaccgcccuggccaccgccggcagagugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcugcaccacaacaacgacacccagcccaccaugagacugcugugcaugcuguacaccccccugagaaccggcggcgccagcggcggcaccgacagcuucguggugagcggcagagugcugaccugccccggccccgacuucaacuuccuguuccuggugccccccaccguggagcagaagaccagacccuucaccgugcccaacaucccccugaagugccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagggcgugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugagcagcaucacccuggacgagaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24619 - RNA, 1623 nt, Artificial Sequence
  derived and/or modified sequence opt4 from VP1__Norovirus_and/or_Norovirus-like__AF414402
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcagagugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggugggcagagugcugaccugccccggccccgacuucaacuuccuguuccuggugccccccaccguggagcagaagaccagacccuucaccgcccccaacaucccccugaaguaccugagcaacagcagaauccccaaccccaucgagggcaugagccugagccccgaccagacccagaacgugcaguuccagaacggcagaugcaccaucgacggccagccccugggcgccacccccgugagcgugagccagcugugcaaguucagaggcagaaucaccagcggccagagagcccugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugcccagcaucacccuggacgagaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24620 - RNA, 1623 nt, Artificial Sequence
  derived and/or modified sequence opt4 from VP1__Norovirus_and/or_Norovirus-like__AJ313030
augaugauggccagcaaggacgccacccccagcgccgacggcgcccugggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagagcggcagaugcaccaucgacggccagccccugggcaccacccccgugagcgugagccagcugugcaaguucagaggcagaaucaccagcggccagaaggugcugaaccugaccggccuggacggcagccccuucauggccuucgccgcccccgcccccgccggcuuccccgaccugggcagcugcgacuggcacaucgagaugagcaagauccccaacagcagcacccagaacaaccccaucgugaucaacagcgugaagcccaacagccagcaguucgugccccaccugagcagcaucacccuggacgagaacgugcugagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccagaggccccgccagaggcagacuguga

SEQ ID NO: 24621 - RNA, 1623 nt, Artificial Sequence
  derived and/or modified sequence opt4 from VP1__Norovirus_and/or_Norovirus-like__KM036381
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagaaggugcugaaccugaccgagcuggacggcagccccuucauggccuucgccgcccccgcccccgccggcuuccccgaccugggcagcugcgacuggcacaucgagaugagcaagauccccaacagcagcaccgagagcaaccccaucguggugaacagcgugaagcccaacagccagcaguucgugccccaccugagcagcaucacccuggacgacaacgugagcagcggcggcgacuacaucggcaccauccaguggaccagcccccccagcgacagcggcggcgccaacaccaacuucuggaagauccccaacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24622 - RNA, 1623 nt, Artificial Sequence
  derived and/or modified sequence opt4 from VP1__Norovirus_and/or_Norovirus-like__LN854563
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucguggugaacagcgugaagcccaacagccagcaguucgugccccaccugagcagcaucacccuggacgacaucgugagcagcggcggcgacuacaucggcaccauccaguggaccagcccccccagcgacagcggcggcgccaacaccaacuucuggaagauccccgacuacggcagcagccugagcgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24623 - RNA, 1623 nt, Artificial Sequence
  derived and/or modified sequence opt4 from VP1__Norovirus_and/or_Norovirus-like__AB042808
augaugauggccagcaaggacgccacccccagcgccgacggcgccaccggcgccggccagcuggugcccgaggugaacaccgccgaccccauccccaucgaccccguggccggcagcagcaccgcccuggccaccgccggccaggugaaccugaucgaccccuggaucaucaacaacuucgugcaggccccccagggcgaguucaccaucagccccaacaacacccccggcgacgugcuguucgaccugcagcugggcccccaccugaaccccuuccugagccaccugagccagauguacaacggcugggugggcaacaugagagugagaguggugcuggccggcaacgccuucaccgccggcaaggugaucaucugcugcgugccccccggcuuccagagcagaacccugagcaucgcccaggccacccuguucccccacgugaucgccgacgugagaacccuggaccccguggaggugccccuggaggacgugagaaacgugcuguaccacaacaacgacacccagcccaccaugagacugcugugcaugcuguacaccccccugagaaccggcggcgccagcggcggcaccgacagcuucgugguggccggcagagugcugaccugccccggccccgacuucaacuuccuguuccuggugccccccaccguggagcagaagaccagacccuucaccgugcccaacaucccccugaaguaccugagcaacagcagaauccccaaccccaucgagggcaugagccugagccccgaccagacccagaacgugcaguuccagaacggcagaugcaccaucgacggccagccccugggcaccacccccgugagcgugagccagcugugcaaguucagaggcagaaucaccagcggccagagagugcugaaccugaccgagcuggacggcagccccuucauggccuucgccgcccccgcccccgccggcuuccccgaccugggcagcugcgacuggcacaucgagaugagcaagauccccaacagcagcacccagaacaaccccaucgugaccaacagcgugaagcccaacagccagcaguucgugccccaccugagcagcaucacccuggacgagaacgugagcagcggcggcgacuacaucggcaccauccaguggaccagcccccccagcgacagcggcggcgccaacaccaacuucuggaagauccccgacuacggcagcagccuggccgaggccagccagcuggcccccgccguguacccccccggcuucaacgaggugaucguguacuucauggccagcauccccggccccaaccagagcggcagccccaaccuggugcccugccugcugccccaggaguacaucacccacuucaucagcgagcaggcccccauccagggcgaggccgcccugcugcacuacguggaccccgacaccaacagaaaccugggcgaguucaagcuguaccccggcggcuaccugaccugcgugcccaacagcagcagcaccggcccccagcagcugccccuggacggcguguucguguucgccagcugggugagcagauucuaccagcugaagcccgugggcaccgccggccccgccagaggcagacuguga

SEQ ID NO: 24624 - RNA, 1623 nt, Artificial Sequence
  derived and/or modified sequence opt4 from VP1__Norovirus_and/or_Norovirus-like__EU004679
augagaaugagcgacggcgccgcccccaaggccaacggcagcgaggccagcggccaggaccuggugcccaccgccaucgagcaggccgugcccauccagcccguggccggcagcgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcaagguguacgccagccuggccguggccgccagccuggaccugguggacggcagagugagagccgugcccagaagcaucuacggcuuccaggacgugauccccgaguacaacgacggccugcuggugccccuggccccccccaucggccccuuccugcccggcgagauccugcugagauucagaaccuacaugagacagcuggacaccgccgacgccgccgccgaggccaucgacugcgcccugccccaggaguucaucagcugguucgccagcaacgccuucaccgugcaggccgacgcccugcugcugagauacagaaacacccugaccggccagcugcuguucgagugcaagcuguacagcgagggcuacaucgcccugagcuacagcggcagcgccccccugaccuuccccaccgacggcuucuucgagguggugagcugggugcccagacuguuccagcuggccagcgugggcagccugaccaccggcagaacccugaaguga

SEQ ID NO: 24625 - RNA, 1623 nt, Artificial Sequence
  derived and/or modified sequence opt4 from VP1__Norovirus_and/or_Norovirus-like__EU004678
augagaaugagcgacggcgccgcccccaaggccaacggcagcgaggccagcggccaggaccuggugcccaccgccguggagcaggccgugcccauccagcccguggccggcagcgcccuggccgcccccgccgccggccagaucaaccagaucgaccccuggaucuuccagaacuucgugcagugcccccugggcgaguucagcaucagccccagaaacacccccggcgagauccuguucgaccuggcccugggccccggccugaaccccuaccuggcccaccugagcgccauguacaccggcugggugggcaacauggaggugcagcuggugcuggccggcaacgccuucaccgccggcaagguggugguggcccuggugccccccuacuuccccaagggcagccugaccaccgcccagaucaccugcuucccccacgugaugugcgacgugagaacccuggagcccauccagcugccccugcuggacgugagaagagugcuguggcacgccacccaggaccaggaggagagcaugagacuggugugcaugcuguacaccccccugagaaccaacagccccggcgacgagagcuucguggugagcggcagacugcugagcaagcccgccgccgacuucaacuucguguaccugaccccccccaucgagagaaccaucuacagaaugguggaccugcccgugcugcagcccagacugugcacccacgccagauggcccgcccccaucuacggccugcugguggaccccagccugcccagcaacccccaguggcagaacggcagagugcacguggacggcacccugcugggcaccacccccgugagcggcagcugggugagcugcuucgccgccgaggccgccuacgaguuccagagcggcaccggcgagguggccaccuucacccugaucgagcaggacggcagcgccuacgugcccggcgacagagccgccccccugggcuaccccgacuucagcggccagcuggagaucgaggugcagaccgagaccaccaagaccggcgacaagcugaaggugaccaccuucgagaugauccugggccccaccaccaacguggaccaggcccccuaccagggcagaguguacgccagccugaccgccguggccagccuggaccugguggacggcagagugagagccgugcccagaagcaucuacggcuuccaggacgugauccccgaguacaacgacggccugcuggugccccuggccccccccaucggccccuuccugcccggcgaggugcugcugagauucagaaccuacaugagacagcuggacaccgccgacgccgccgccgaggccaucgacugcgcccugccccaggaguucaucagcugguucgccagcaacgccuucaccgugcagagcgacgcccugcugcugagauacagaaacacccugaccggccagcugcuguucgagugcaagcuguacagcgagggcuacaucgcccugagcuacagcggcagcggcccccugaccuuccccaccgacggcuucuucgagguggugagcugggugcccagacuguuccagcuggccagcgugggcagccugaccaccggcagaacccugaaguga

SEQ ID NO: 24626 - RNA, 1623 nt, Artificial Sequence
  derived and/or modified sequence opt4 from VP1__Norovirus_and/or_Norovirus-like__AB281085
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacgcccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaucgccagcggccacaacgagcccgccaacagaggccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcaaccccgccaucgacugccugcugccccaggagugggugcagcacuucuaccaggagagcgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24627 - RNA, 1623 nt, Artificial Sequence
  derived and/or modified sequence opt4 from VP1__Norovirus_and/or_Norovirus-like__AB662868
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgagcaccuguacaacgugaccaucaucaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccaacaaccagcccgugaaguucacccccgugggccugaacgacaccgagcacuucgaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24628 - RNA, 1623 nt, Artificial Sequence
  derived and/or modified sequence opt4 from VP1__Norovirus_and/or_Norovirus-like__AB662861
augaagauggccagcaacgacgccgugcccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgagcaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccaggugcagaucggcaccuggcagaccgacgaccugaccgacaaccagcccgugaaguucacccccgugggccugaacgacaccgagcacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24629 - RNA, 1623 nt, Artificial Sequence
  derived and/or modified sequence opt4 from VP1__Norovirus_and/or_Norovirus-like__LC145791
augaagauggccagcaacgacguggcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24630 - RNA, 1623 nt, Artificial Sequence
  derived and/or modified sequence opt4 from VP1__Norovirus_and/or_Norovirus-like__LC145790
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24631 - RNA, 1623 nt, Artificial Sequence
  derived and/or modified sequence opt4 from VP1__Norovirus_and/or_Norovirus-like__LC145793
augaagauggccagcaacgacgccgcccccagcaccgacggcgccgccggccuggugcccgagagcaacaacgaggugauggcccuggagcccguggccggcguggcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucgagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24632 - RNA, 1623 nt, Artificial Sequence
  derived and/or modified sequence opt4 from VP1__Norovirus_and/or_Norovirus-like__LC145792
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccagugggugcugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24633 - RNA, 1623 nt, Artificial Sequence
  derived and/or modified sequence opt4 from VP1__Norovirus_and/or_Norovirus-like__LC145797
augaagauggccagcaacgacgccgcccccagcaccgacggcgccgccggccuggugcccgagagcaacaacgaggugauggcccuggagcccguggccggcguggcccuggccgcccccgugaccggccagaccaacaucaucgaccccuggaucagagccaacuucgugcccgcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcuguucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacaucagcggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24634 - RNA, 1623 nt, Artificial Sequence
  derived and/or modified sequence opt4 from VP1__Norovirus_and/or_Norovirus-like__LC145808
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgcccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24635 - RNA, 1623 nt, Artificial Sequence
  derived and/or modified sequence opt4 from VP1__Norovirus_and/or_Norovirus-like__LC145801
augaagauggccagcaacgacgccgcccccagcaccgacggcgccgccggccuggugcccgagagcaccaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgcccccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24636 - RNA, 1623 nt, Artificial Sequence
  derived and/or modified sequence opt4 from VP1__Norovirus_and/or_Norovirus-like__AB662884
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24637 - RNA, 1623 nt, Artificial Sequence
  derived and/or modified sequence opt4 from VP1__Norovirus_and/or_Norovirus-like__LC145802
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggccacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgaguucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggccagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacgcccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucgaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24638 - RNA, 1623 nt, Artificial Sequence
  derived and/or modified sequence opt4 from VP1__Norovirus_and/or_Norovirus-like__AB662897
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcaccagcgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24639 - RNA, 1623 nt, Artificial Sequence
  derived and/or modified sequence opt4 from VP1__Norovirus_and/or_Norovirus-like__AB662899
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24640 - RNA, 1623 nt, Artificial Sequence
  derived and/or modified sequence opt4 from VP1__Norovirus_and/or_Norovirus-like__AB662894
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgccaacuucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24641 - RNA, 1623 nt, Artificial Sequence
  derived and/or modified sequence opt4 from VP1__Norovirus_and/or_Norovirus-like__LC145803
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagcagcuucgaccccagcgaggacauccccgccccccugggcauccccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24642 - RNA, 1623 nt, Artificial Sequence
  derived and/or modified sequence opt4 from VP1__Norovirus_and/or_Norovirus-like__AB662889
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagagcuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgugggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24643 - RNA, 1623 nt, Artificial Sequence
  derived and/or modified sequence opt4 from VP1__Norovirus_and/or_Norovirus-like__AB662876
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaacuucacccccgccggccugagcgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagaagauga

SEQ ID NO: 24644 - RNA, 1620 nt, Artificial Sequence
  derived and/or modified sequence opt4 from VP1__Norovirus_and/or_Norovirus-like__KU555841
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacagcaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgcccagaucaaccagagagacagauggcacaugcagcugcagaaccugaacggcaccaccuacgaccccaccgacgacgugcccgccccccugggcacccccgacuucaagggcgugguguucggcauggugagccagagaaacgugggcagcgacgcccccggcagcaccagagcccagcaggccugggugagcaccuacagcccccaguucgugcccaagcugggcagcgugaaccugagaaucagcgacaacgacgacuuccaguuccagcccaccaaguucacccccgugggcgugaacgacgacgacggccaccccuucagacagugggagcugcccaacuacagcggcgagcugacccugaacaugaaccuggccccccccguggcccccaacuuccccggcgagcagcugcuguucuucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggccacuucagauucgacagcugggugaaccaguucuacagccuggcccccaugggcaccggcaacggcagaagaagagcccaguga

SEQ ID NO: 24645 - RNA, 1620 nt, Artificial Sequence
  derived and/or modified sequence opt4 from VP1__Norovirus_and/or_Norovirus-like__GQ856468
augaagauggccagcaacgacgccgcccccagcaacgacggcgccaccggccuggugcccgagaucaacaccgagacccugccccuggagcccguggccggcgccgccaucgccgcccccgugaccggccagaacaacaucaucgaccccuggaucagaaacaacuucgugcaggcccccaacggcgaguucaccgugagccccagaaacagccccggcgagauccugaugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggacaugcugagccccgcccagaucaccaugcugccccaccugaucguggacgugagaacccuggagcccaucaugaucccccugcccgacgugagaaacguguucuaccacuucaacaaccagcccgcccccagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucacccugcccauccugaccaucggcgagcugaccaacagcagauuccccgcccccaucgaccagcuguacaccagccccaacgccgacaucguggugcagccccagaacggcagaugcacccuggacggcgagcugcagggcaccacccagcugcugaccaccgccaucugcagcuacagaggcaugaccagcaaccccaccagcgacuacugggacgaccaccugcugcaccuggugcaccccaacggcgccaccuacgaccccaccgaggacgugcccgcccccuucggcacccaggacuucagaggcauccuguacggcaugcugacccagaaccccagaaccagcggcgacgaggccgccaacagccacggcaucuacaucagcagcaccagcgagaaguucacccccaagcugggcaccaucggccugcaccaggugcagggcagacacagccagcaccagcagagcaaguucacccccgugggcaucgccgugaacggcaacacccccuucagacagugggagcugcccaacuacagcggcgcccugacccugaacaccaaccuggcccccgccgugggccccaacuuccccggcgagcagauccuguucuucagaagcaacgugcccagcgugcagggcggccagcccaucgagaucgacugccugaucccccaggagugggugagccacuucuaccaggagagcgcccccagccagagcgacguggcccuggugagauacgugaaccccgacaccggcagaaccaucuucgaggccaagcugcacagacagggcuucaucaccaucgccgccaccggcagcaaccccgugguggugccccccaacggcuacuucagauucgacagcugggugaaccaguucuacgcccuggcccccaugggcaccggcaacggcagaagaagagugcaguga

SEQ ID NO: 24646 - RNA, 1620 nt, Artificial Sequence
  derived and/or modified sequence opt4 from VP1__Norovirus_and/or_Norovirus-like__AB684681
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccgccaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgcccccaucgacagccuguucaccgcccagaacaacgugcugcaggugcagugccagaacggcagaugcacccuggacggcgagcugcagggcaccacccagcugcugcccaccggcaucugcgccuucagaggcagagugaccgccgagaccgacaaccccgacaaguggcacaugcagcugcagaaccugaacggcaccaccuacgaccccaccgacgacgugcccgccccccugggcacccccgacuucagaggccugcuguucggcguggccagccagagaaacgugggcaacgacgcccccggcagcaccagagcccacgagguggugaucagcaccaccagcccccaguucgugcccaagcugggcagcaucaacuucagaagcaccagcgaggacuucagaaccggccagcccaccagauucacccccgugggcaucaacgacgaggacaaccaccccuucaaccagugggagcugcccgacuacagcggcagacugacccugaacaugaaccuggccccccccguggcccccaacuuccccggcgagcagcugcuguucuucagaagcaacgugcccugcagcggcggcuacaaccagggcaucaucgacugccugaucccccaggaguggauccagcacuucuaccaggagagcgcccccagccagagcgagguggcccugaucagauacgugaaccccgacaccggcagaacccuguucgaggccaagcugcacagaaccggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24647 - RNA, 1620 nt, Artificial Sequence
  derived and/or modified sequence opt4 from VP1__Norovirus_and/or_Norovirus-like__AB809988
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagauga

SEQ ID NO: 24648 - RNA, 1620 nt, Artificial Sequence
  derived and/or modified sequence opt4 from VP1__Norovirus_and/or_Norovirus-like__AB810011
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagauga

SEQ ID NO: 24649 - RNA, 1620 nt, Artificial Sequence
  derived and/or modified sequence opt4 from VP1__Norovirus_and/or_Norovirus-like__AB809994
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagagacaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagaagauga

SEQ ID NO: 24650 - RNA, 1620 nt, Artificial Sequence
  derived and/or modified sequence opt4 from VP1__Norovirus_and/or_Norovirus-like__KX767083
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcauccccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucggcaccgacaccagcaacgacuucgaggccaaccagaacaccaaguucacccccgugggcgugauccaggacggcgacaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24651 - RNA, 1620 nt, Artificial Sequence
  derived and/or modified sequence opt4 from VP1__Norovirus_and/or_Norovirus-like__LN854565
augaagauggccagcaacgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccauccccauccugaccguggaggagaugaccaacagcagauuccccaucccccuggagaagcuguacaccggccccagcagcgccuucguggugcagccccagaacggcagaugcaccaccgacggcgugcugcugggcaccacccagcugagccccgugaacaucugcaccuucagaggcgacgugaccaacauccagggcagccacaccuacaccaugaaccuggccagccugaacuggaacaacuacgaccccaccgaggagacccccgccccccugggcacccccgacuucgugggcaagauccagggcgugcugacccagaccaccaagggccagggcagcaccagaggccacaaggccaccguguacaccggcagcgccagcuucacccccaagcugggcagcgugcaguucagaaccgacacccagaacgacuucgugacccaccagaacaccaaguucacccccgugggcgugauccaggacggcgacaccacccacagaaacgagccccagcagugggugcugcccaacuacagcggcgugaacacccacaacgugcaccuggcccccgccguggcccccaccauccccggcgagcagcugcuguucuucagaagcagcaugcccggcugcagcggcuaccccaacauggaccuggacugccuggugccccaggagugggugcagcacuucuaccaggaggccgcccccgcccugagcgacguggcccugcugagauucgugaaccccgacaccggcagagugcuguucgagugcaagcugcacaagagcggcuacgugaccguggcccacaccggccaccacgaccuggugaucccccccaacggcuacuucagauucgacagcugggugaaccaguucuacacccuggcccccaugggcaacggcaccggcagaagaagaguguga

SEQ ID NO: 24652 - RNA, 1620 nt, Artificial Sequence
  derived and/or modified sequence opt4 from VP1__Norovirus_and/or_Norovirus-like__KX354071
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccagaacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24653 - RNA, 1620 nt, Artificial Sequence
  derived and/or modified sequence opt4 from VP1__Norovirus_and/or_Norovirus-like__AB933688
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagauccaccagaacaccaaguucacccccgugggcgugauccaggacggcagcaccacccacagaaacgagccccagcagugggugcugcccagcuacagcggcagagacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24654 - RNA, 1620 nt, Artificial Sequence
  derived and/or modified sequence opt4 from VP1__Norovirus_and/or_Norovirus-like__GQ845337
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugauccccagcaacggcuacuucagauucgacagcugggugaaccaguucuacacccuggcccccaugggcaacggcaccggcagaagaagaguguga

SEQ ID NO: 24655 - RNA, 1620 nt, Artificial Sequence
  derived and/or modified sequence opt4 from VP1__Norovirus_and/or_Norovirus-like__JX155747
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24656 - RNA, 1620 nt, Artificial Sequence
  derived and/or modified sequence opt4 from VP1__Norovirus_and/or_Norovirus-like__JX155737
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24657 - RNA, 1620 nt, Artificial Sequence
  derived and/or modified sequence opt4 from VP1__Norovirus_and/or_Norovirus-like__KX354055
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24658 - RNA, 1620 nt, Artificial Sequence
  derived and/or modified sequence opt4 from VP1__Norovirus_and/or_Norovirus-like__KX353957
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguucaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24659 - RNA, 1620 nt, Artificial Sequence
  derived and/or modified sequence opt4 from VP1__Norovirus_and/or_Norovirus-like__KF509947
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaucguguacaccggcagcgccgacuucgcccccaagcugggcagagugcaguucgagaccgacaccgaccacgacuucgaggccaaccagaacaccaaguucacccccgugggcgugacccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24660 - RNA, 1620 nt, Artificial Sequence
  derived and/or modified sequence opt4 from VP1__Norovirus_and/or_Norovirus-like__AB504326
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24661 - RNA, 1620 nt, Artificial Sequence
  derived and/or modified sequence opt4 from VP1__Norovirus_and/or_Norovirus-like__KX354056
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcugggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24662 - RNA, 1620 nt, Artificial Sequence
  derived and/or modified sequence opt4 from VP1__Norovirus_and/or_Norovirus-like__AB541255
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24663 - RNA, 1620 nt, Artificial Sequence
  derived and/or modified sequence opt4 from VP1__Norovirus_and/or_Norovirus-like__KP784696
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcgagauccagggcgugcugacccagaccaccagaaccgacggcagcaccagaggccacaaggccaccguguacaccggcagcgccgacuucgcccccaagcugggcagaauccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccagccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24664 - RNA, 1620 nt, Artificial Sequence
  derived and/or modified sequence opt4 from VP1__Norovirus_and/or_Norovirus-like__KX354042
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagcagcgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24665 - RNA, 1620 nt, Artificial Sequence
  derived and/or modified sequence opt4 from VP1__Norovirus_and/or_Norovirus-like__KX354007
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggaggugcccgccccccugggcacccccgacuucgugggcaagauccagggcaugcugacccagaccaccagaaccgacggcagcaccagaggccacaaggccaccguguacaccggcagcgccgacuucacccccaagcugggcagaauccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24666 - RNA, 1620 nt, Artificial Sequence
  derived and/or modified sequence opt4 from VP1__Norovirus_and/or_Norovirus-like__KT780393
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugacccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24667 - RNA, 1620 nt, Artificial Sequence
  derived and/or modified sequence opt4 from VP1__Norovirus_and/or_Norovirus-like__KX354043
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacaccuacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24668 - RNA, 1620 nt, Artificial Sequence
  derived and/or modified sequence opt4 from VP1__Norovirus_and/or_Norovirus-like__KX354008
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggaggugcccgccccccugggcacccccgacuucgugggcaagauccagggcaugcugacccagaccaccagaaccgacggcagcaccagaggccacaaggccaccguguacaccggcagcgccgacuucacccccaagcugggcagaauccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagaguguga

SEQ ID NO: 24669 - RNA, 1620 nt, Artificial Sequence
  derived and/or modified sequence opt4 from VP1__Norovirus_and/or_Norovirus-like__KR904217
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcagcaccgacggcgugcugcugggcaccacccagcugagccccgugaacaucugcaccuucagaggcgacgugacccacaucgccggcagccacaacuacaccaugaaccuggccagccagaacuggagcagcuacgaccccaccgaggagauccccgccccccugggcacccccgacuucgugggcaagauccagggcgugcugacccagaccaccagaagcgacggcagcaccagaggccacaaggccaccguguacaccggcagcgccgacuucagccccaagcugggcagagugcaguucgccaccgacaccgacaacgacuucgugagcaaccagaacaccaaguucacccccgugggcgugauccaggacggcgacaccgcccacagaaacgagccccagcagugggugcugcccagcuacagcggcagaaacauccacaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccacuucuacacccuggcccccaugggcaacggcaccggcagaagaagaguguga

SEQ ID NO: 24670 - RNA, 1620 nt, Artificial Sequence
  derived and/or modified sequence opt4 from VP1__Norovirus_and/or_Norovirus-like__KJ685412
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgccaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24671 - RNA, 1620 nt, Artificial Sequence
  derived and/or modified sequence opt4 from VP1__Norovirus_and/or_Norovirus-like__KF008240
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24672 - RNA, 1620 nt, Artificial Sequence
  derived and/or modified sequence opt4 from VP1__Norovirus_and/or_Norovirus-like__KX354125
augaagauggccagcagcgacgccaaccccagcgacggcagcgccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagaguguga

SEQ ID NO: 24673 - RNA, 1620 nt, Artificial Sequence
  derived and/or modified sequence opt4 from VP1__Norovirus_and/or_Norovirus-like__KX354094
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24674 - RNA, 1620 nt, Artificial Sequence
  derived and/or modified sequence opt4 from VP1__Norovirus_and/or_Norovirus-like__KX354058
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgaguucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24675 - RNA, 1620 nt, Artificial Sequence
  derived and/or modified sequence opt4 from VP1__Norovirus_and/or_Norovirus-like__KX354057
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgaguucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24676 - RNA, 1620 nt, Artificial Sequence
  derived and/or modified sequence opt4 from VP1__Norovirus_and/or_Norovirus-like__KX354034
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24677 - RNA, 1620 nt, Artificial Sequence
  derived and/or modified sequence opt4 from VP1__Norovirus_and/or_Norovirus-like__KX354027
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagaguguga

SEQ ID NO: 24678 - RNA, 1620 nt, Artificial Sequence
  derived and/or modified sequence opt4 from VP1__Norovirus_and/or_Norovirus-like__KX354025
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24679 - RNA, 1620 nt, Artificial Sequence
  derived and/or modified sequence opt4 from VP1__Norovirus_and/or_Norovirus-like__KJ685406
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24680 - RNA, 1620 nt, Artificial Sequence
  derived and/or modified sequence opt4 from VP1__Norovirus_and/or_Norovirus-like__KF008241
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24681 - RNA, 1620 nt, Artificial Sequence
  derived and/or modified sequence opt4 from VP1__Norovirus_and/or_Norovirus-like__AB504327
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaagcgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccagauucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24682 - RNA, 1620 nt, Artificial Sequence
  derived and/or modified sequence opt4 from VP1__Norovirus_and/or_Norovirus-like__KY424329
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaacuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24683 - RNA, 1620 nt, Artificial Sequence
  derived and/or modified sequence opt4 from VP1__Norovirus_and/or_Norovirus-like__KT780389
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaaagagaguguga

SEQ ID NO: 24684 - RNA, 1620 nt, Artificial Sequence
  derived and/or modified sequence opt4 from VP1__Norovirus_and/or_Norovirus-like__KX354134
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24685 - RNA, 1620 nt, Artificial Sequence
  derived and/or modified sequence opt4 from VP1__Norovirus_and/or_Norovirus-like__KX354126
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagaguguga

SEQ ID NO: 24686 - RNA, 1620 nt, Artificial Sequence
  derived and/or modified sequence opt4 from VP1__Norovirus_and/or_Norovirus-like__KR904237
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagagacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaaucuga

SEQ ID NO: 24687 - RNA, 1620 nt, Artificial Sequence
  derived and/or modified sequence opt4 from VP1__Norovirus_and/or_Norovirus-like__KP241911
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24688 - RNA, 1620 nt, Artificial Sequence
  derived and/or modified sequence opt4 from VP1__Norovirus_and/or_Norovirus-like__KJ685411
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccugaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24689 - RNA, 1620 nt, Artificial Sequence
  derived and/or modified sequence opt4 from VP1__Norovirus_and/or_Norovirus-like__KF008242
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagaguguga

SEQ ID NO: 24690 - RNA, 1620 nt, Artificial Sequence
  derived and/or modified sequence opt4 from VP1__Norovirus_and/or_Norovirus-like__KF060112
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24691 - RNA, 1620 nt, Artificial Sequence
  derived and/or modified sequence opt4 from VP1__Norovirus_and/or_Norovirus-like__JX126912
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcgugauccaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24692 - RNA, 1620 nt, Artificial Sequence
  derived and/or modified sequence opt4 from VP1__Norovirus_and/or_Norovirus-like__KX354143
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaucguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24693 - RNA, 1620 nt, Artificial Sequence
  derived and/or modified sequence opt4 from VP1__Norovirus_and/or_Norovirus-like__KU985164
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagaguguga

SEQ ID NO: 24694 - RNA, 1620 nt, Artificial Sequence
  derived and/or modified sequence opt4 from VP1__Norovirus_and/or_Norovirus-like__KX950760
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcauccccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccaacggcagcaccagaggccacaaggccaccguguacaccggcagcgccgacuucgcccccaagcugggcagagugcaguucgagaccgacaccagcgacgacuucgagaccagccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaucaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24695 - RNA, 1620 nt, Artificial Sequence
  derived and/or modified sequence opt4 from VP1__Norovirus_and/or_Norovirus-like__KJ685402
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24696 - RNA, 1620 nt, Artificial Sequence
  derived and/or modified sequence opt4 from VP1__Norovirus_and/or_Norovirus-like__KF060140
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacaucagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24697 - RNA, 1620 nt, Artificial Sequence
  derived and/or modified sequence opt4 from VP1__Norovirus_and/or_Norovirus-like__KX354132
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaccaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24698 - RNA, 1620 nt, Artificial Sequence
  derived and/or modified sequence opt4 from VP1__Norovirus_and/or_Norovirus-like__KX354006
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggaggugcccgccccccugggcacccccgacuucgugggcaagauccagggcaugcugacccagaccaccagaaccgacggcagcaccagaggccacaaggccaccguguacaccggcagcgccgacuucacccccaagcugggcagaauccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggccagcgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagaguguga

SEQ ID NO: 24699 - RNA, 1620 nt, Artificial Sequence
  derived and/or modified sequence opt4 from VP1__Norovirus_and/or_Norovirus-like__KX354145
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24700 - RNA, 1620 nt, Artificial Sequence
  derived and/or modified sequence opt4 from VP1__Norovirus_and/or_Norovirus-like__KX354140
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccuggccacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24701 - RNA, 1620 nt, Artificial Sequence
  derived and/or modified sequence opt4 from VP1__Norovirus_and/or_Norovirus-like__KX354119
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24702 - RNA, 1620 nt, Artificial Sequence
  derived and/or modified sequence opt4 from VP1__Norovirus_and/or_Norovirus-like__KX354018
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucggcgccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24703 - RNA, 1620 nt, Artificial Sequence
  derived and/or modified sequence opt4 from VP1__Norovirus_and/or_Norovirus-like__AB972499
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24704 - RNA, 1620 nt, Artificial Sequence
  derived and/or modified sequence opt4 from VP1__Norovirus_and/or_Norovirus-like__KF060142
augaagauggccagcagcgacgccaaccccagcgacggcagcgccgccaaccuggugcccgaggugaacaacgaggugauggcccuggaccccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24705 - RNA, 1620 nt, Artificial Sequence
  derived and/or modified sequence opt4 from VP1__Norovirus_and/or_Norovirus-like__KF060138
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24706 - RNA, 1620 nt, Artificial Sequence
  derived and/or modified sequence opt4 from VP1__Norovirus_and/or_Norovirus-like__KP784697
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgacccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24707 - RNA, 1620 nt, Artificial Sequence
  derived and/or modified sequence opt4 from VP1__Norovirus_and/or_Norovirus-like__KF060111
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24708 - RNA, 1620 nt, Artificial Sequence
  derived and/or modified sequence opt4 from VP1__Norovirus_and/or_Norovirus-like__KF060089
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24709 - RNA, 1620 nt, Artificial Sequence
  derived and/or modified sequence opt4 from VP1__Norovirus_and/or_Norovirus-like__KP096333
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagacccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24710 - RNA, 1620 nt, Artificial Sequence
  derived and/or modified sequence opt4 from VP1__Norovirus_and/or_Norovirus-like__KF060153
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagguggaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24711 - RNA, 1620 nt, Artificial Sequence
  derived and/or modified sequence opt4 from VP1__Norovirus_and/or_Norovirus-like__KF060125
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagguggaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcacccugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24712 - RNA, 1620 nt, Artificial Sequence
  derived and/or modified sequence opt4 from VP1__Norovirus_and/or_Norovirus-like__KX354135
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguuccugaagagcaccaugcccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24713 - RNA, 1620 nt, Artificial Sequence
  derived and/or modified sequence opt4 from VP1__Norovirus_and/or_Norovirus-like__KX354045
augaagauggccagcagcgacgccaaccccagcgacggcagcgccgccaaccuggugcccgacgugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24714 - RNA, 1620 nt, Artificial Sequence
  derived and/or modified sequence opt4 from VP1__Norovirus_and/or_Norovirus-like__LC153121
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24715 - RNA, 1620 nt, Artificial Sequence
  derived and/or modified sequence opt4 from VP1__Norovirus_and/or_Norovirus-like__KF668568
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccaucccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcggcgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaucaccaaguucacccccaucggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24716 - RNA, 1620 nt, Artificial Sequence
  derived and/or modified sequence opt4 from VP1__Norovirus_and/or_Norovirus-like__KF668567
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacgugagcaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccaucggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24717 - RNA, 1620 nt, Artificial Sequence
  derived and/or modified sequence opt4 from VP1__Norovirus_and/or_Norovirus-like__KR904210
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccuggagacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacagcaaccagaacaccaaguucacccccgugggcgugauccaggacggcggcaccacccacagaaacgagccccagcagugggugcugcccagcuacagcggcagagacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24718 - RNA, 1620 nt, Artificial Sequence
  derived and/or modified sequence opt4 from VP1__Norovirus_and/or_Norovirus-like__JX459907
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgacgagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24719 - RNA, 1620 nt, Artificial Sequence
  derived and/or modified sequence opt4 from VP1__Norovirus_and/or_Norovirus-like__KF060062
augaagauggccagcagcgacgccaaccccaccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24720 - RNA, 1620 nt, Artificial Sequence
  derived and/or modified sequence opt4 from VP1__Norovirus_and/or_Norovirus-like__KF060080
augaagauggccagcagcgacgccaaccccagcgacggcagcgccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24721 - RNA, 1620 nt, Artificial Sequence
  derived and/or modified sequence opt4 from VP1__Norovirus_and/or_Norovirus-like__KF378731
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcacccugagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggcuacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24722 - RNA, 1620 nt, Artificial Sequence
  derived and/or modified sequence opt4 from VP1__Norovirus_and/or_Norovirus-like__AB933731
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcaaggugagccccaucccccugaagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24723 - RNA, 1620 nt, Artificial Sequence
  derived and/or modified sequence opt4 from VP1__Norovirus_and/or_Norovirus-like__AB933749
augaagauggccagcaacgacgugaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccguggugagaaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24724 - RNA, 1620 nt, Artificial Sequence
  derived and/or modified sequence opt4 from VP1__Norovirus_and/or_Norovirus-like__KC517370
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugcccagcaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacacccugcugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccauguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagacccaccaugcccggcugcagcggcuaccccaacauggaccuggacagacugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagaguguga

SEQ ID NO: 24725 - RNA, 1620 nt, Artificial Sequence
  derived and/or modified sequence opt4 from VP1__Norovirus_and/or_Norovirus-like__EF547396
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgaggugccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcaacggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacagccccaacaccagcaucaucugcacccuggacuggcugagccagaccaccggccagagcaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacuguga

SEQ ID NO: 24726 - RNA, 1620 nt, Artificial Sequence
  derived and/or modified sequence opt4 from VP1__Norovirus_and/or_Norovirus-like__JN699047
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcaacggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgaccacgacuacgaccccaacaccagcaucaucugcacccuggacuggcugagccagaccaccggccagaacaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacuguga

SEQ ID NO: 24727 - RNA, 1620 nt, Artificial Sequence
  derived and/or modified sequence opt4 from VP1__Norovirus_and/or_Norovirus-like__KT781411
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccagccagaacaucagcaucgcccaggccaccauguucccccacgugaucgccgacgugagagugcuggagcccaucgaggugccccuggaggacgugagaaacgugcuguuccacaacaacgacaacagccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaacgccaugaugaucagcagagaccacggccagauggugcaguuccagaacggcagagugacccuggacggccagcugcagggcaccacccccaccagccugagccagcugugcaagaucagaggcaagguguuccuggccagcggcggcaacggccugaaccugaccgagcuggacggcagcgccuaccacgccuucgagagccccgcccccaucggcuuccccgacaucggcgacugcgacuggcacaugaacgccaccgccaccagcaacuucaccggcagcaacgacgagcaccagauccuggugaagcaggagagcaccuucgccccccaccugggccacgugcaggccgaccaccugcccgagguggccaacaccgaccugauggugagccugagcuggaucagccccgugagcgaccagcacagaagagacguggaccccugggugauccccagauacggcagcacccugaccgaggccgcccagcuggccccccccaucuacccccccggcuucggcgaggccaucguguucuucaugagcgacuuccccguggugagcggcgugaacggcaugagaauccccugcacccugccccaggaguacguggcccacuucgugaacgagcaggcccccaccagaggcgaggccgcccugcugcacuacguggaccccgacacccacagaaaccugggcgaguucaagaucuaccccgagggcuucaugaccugcgugcccaacagcagcggcaccggcccccagacccugcccaucaacggcguguucaccuucgugagcugggugagcagauucuaccagcugaagcccgugggcaccgccggccccgccagaagacuguga

SEQ ID NO: 24728 - RNA, 1620 nt, Artificial Sequence
  derived and/or modified sequence opt4 from VP1__Norovirus_and/or_Norovirus-like__U04469
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugagagugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacagcagccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaacgccaugaugaucagcagagaccacggccagauggugcaguuccagaacggcagagugacccuggacggccagcugcagggcaccacccccaccagccugagccagcugugcaagaucagaggcaagguguuccacgccagcggcggcaacggccugaaccugaccgagcuggacggcagcgccuaccacgccuucgagagccccgcccccaucggcuuccccgacaucggcgacugcgacuggcacaugagcgccaccgccaccaacaacuucaccggcagcagcaacgaguaccagauccugaucaagcaggagagcgccuucgccccccaccugggccacgugcaggccgacaaccugagcgccggcgccaacaccgaccugaucgugagccugagcuggaucagccccgugagcgaccagcacagacacgacguggaccccugggugauccccagauacggcagcagccugaccgaggccgcccagcuggccccccccaucuacccccccggcuucggcgaggccaucguguucuucaugagcgacuuccccguggugagcggcgugaacggcaugagaauccccugcacccugccccaggaguacguggcccacuucgugaacgagcaggcccccaccagaggcgaggccgcccugcugcacuacguggaccccgacacccacagaaaccugggcgaguucaagauguaccccgagggcuucaugaccugcgugcccaacagcagcggcagcggcccccagacccugcccaucaacggcguguucaccuucgugagcugggugagcagauucuaccagcugaagcccgugggcaccgccggccccgccagaagacuguga

SEQ ID NO: 24729 - RNA, 1620 nt, Artificial Sequence
  derived and/or modified sequence opt4 from VP1__Norovirus_and/or_Norovirus-like__JN699049
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccagccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacgugcugagcaacagcagagugcccagccugaucaaguucaugauggugagccaggaccacggccagauggugcaguuccagaacggcagagugacccuggacggccagcugcagggcaccacccccaccagcgccagccagcugugcaagaugagaggcaccguguaccacgccagcggcggccagggccugaaccugaccgagaucgacggcacccccuaccacgccuucgagagccccgcccccaucggcuuccccgaccugggcgacagcgacuggcacaucaacgccagccccgccaccaccuucaacaccggcgagagcgugaagagacuggacauggagcagggcagcagcuucgccccccaccugggcaccgugcacuacaccaacgccgacuacgacgccaacaccgaccugaucugcagccuggaguggcugagcccccccagcggcggcacccccaacaaggugaaccccugggccauccccagauacggcagcacccugaccgaggccgcccagcuggccccccccaucuacccccccggcuucggcgaggccaucguguucuucaugagcgacuuccccaucgccaacggccaggacggccugaaggugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucgugagcugggugagcagauucuaccagcugaagcccgugggcaccaccggccccgugagaagacuguga

SEQ ID NO: 24730 - RNA, 1620 nt, Artificial Sequence
  derived and/or modified sequence opt4 from VP1__Norovirus_and/or_Norovirus-like__GQ856473
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccgcccagaacaucagcaucgcccaggccaccauguucccccacgugaucgccgacgugagagugcuggagcccaucgaggugccccuggaggacgugagaaacgugcuguuccacaacaacgacaacagccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaacgccaugaugaucagcagagaccacggccagauggugcaguuccagaacggcagagugacccuggacggccagcugcagggcaccacccccaccagccugagccagcugugcaagaucagaggcaagguguuccacgccagcggcggcaacggccugaaccugaccgagcuggacggcagcgccuaccacgccuucgagagccccgcccccaucggcuuccccgacaucggcgagugcgacuggcacaugaacgccaccgccaccagcaacuucaccggcagcaacgacgaguaccagauccuggugaagcaggagagcaccuucgccccccaccugggccacgugcaggccgacagccugagcgccgacgccaacaccgaccugauggugagccugagcuggaucagccccgugagcgaccagcacagaagagacguggaccccugggugauccccagauacggcagcagccugaccgaggccgcccagcuggccccccccaucuacccccccggcuucggcgaggccaucguguucuucaugagcgacuuccccguggugagcggcgugaacggcaugagaauccccugcacccugccccaggaguacguggcccacuucgugaacgagcaggcccccaccagaggcgaggccgcccugcugcacuacguggaccccgacacccacagaaaccugggcgaguucaagauguaccccgagggcuucaugaccugcgugcccaacagcagcggcagcggcccccagacccugcccaucaacggcgugcugaccuucgugagcugggugagcagauucuaccagcugaagcccgugggcaccgccggccccgccagaagacuguga

SEQ ID NO: 24731 - RNA, 1620 nt, Artificial Sequence
  derived and/or modified sequence opt4 from VP1__Norovirus_and/or_Norovirus-like__JN699050
augaugauggccagcaaggacgcccccaccaacauggacggcaccagcggcgccggccagcuggugcccgaggccaacaccgccgagcccaucagcauggagcccguggccggcgccgccaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugaaggugcugcuggccggcaacgccuucaccgccggcaagaucaucaucagcugcaucccccccggcuucgccagccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcaugcuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaugagaggcaccguguaccacgccagcggcggccagggccugaaccugaccgagaucgacggcacccccuaccacgccuucgagagccccgcccccaucggcuuccccgacaucggcgacagcgacuggcacaucaacgccagccccgccaccaccuucgacagcggcgagagcaucaagagacuggacauggagcagggcagcagcuucgccccccaccugggcaccgugcacuacaccaacgccgacuaccccgccaacaccgaccugaucugcagccuggaguggcugagcccccccagcggcggcacccccaacaaggugaaccccuggaccauccccagauacggcagcacccugaccgaggccgcccagcuggccccccccaucuacccccccggcuucggcgaggccaucguguucuucaugagcgacuuccccaucgccaacggccaggacggccugaaggugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucgugagcugggugagcagauucuaccagcugaagcccgugggcaccaccggccccgugagaagacuguga

SEQ ID NO: 24732 - RNA, 1620 nt, Artificial Sequence
  derived and/or modified sequence opt4 from VP1__Norovirus_and/or_Norovirus-like__GQ856472
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcagcggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacaaccccaacaccagcaucaucugcacccuggacuggcugagccagaccaccggccagagcaacguggaccccuggcagauccccaccuacggcagcgcccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacuguga

SEQ ID NO: 24733 - RNA, 1620 nt, Artificial Sequence
  derived and/or modified sequence opt4 from VP1__Norovirus_and/or_Norovirus-like__GQ856471
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcagcggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacaaccccaacaccagcaucaucugcacccuggacuggcugagccagaccaccggccagagcaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacgccgaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacuguga

SEQ ID NO: 24734 - RNA, 1620 nt, Artificial Sequence
  derived and/or modified sequence opt4 from VP1__Norovirus_and/or_Norovirus-like__JQ911594
augaugauggccagcaaggacgcccccaccaacauggacggcaccagcggcgccggccagcuggugcccgaggccaacaccgccgagcccaucagcauggaccccguggccggcgccgccaccgccguggccaccgccggccagaucaacaugaucgaccccuggaucaugagcaacuucgugcaggccccccagggcgaguucaccgugagccccaacaacacccccggcgacgugcuguucgaccugcagcugggcccccagcugaaccccuuccuggcccaccuggcccagauguacaacggcugggugggcaacaugagagugaaggugcugcuggccggcaacgccuucaccgccggcaagaucaucaucagcugcaucccccccggcuucaccagccagaacaucagcaucgcccagaugaccauguucccccacgugaucgccgacgugagagugcuggagcccaucgagaucccccuggaggacgugagaaacgugcuguuccacaccaacgacaacagacccaccaugagacuggugugcaugcuguacaccccccugagagccaacggcagcagcagcggcaccgaccccuucgugaucgccggcagagugcugaccugccccgacagcaacuucagcuuccuguuccuggugccccccaacguggagcagaagaccagacccuucagcgugcccaacaucccccugaacacccugagcaacagcagagugcccagccugaucaagagcaugaccaucagcagagaccagaaccagaucauccaguuccagaacggcagagugacccuggacggccagcugcagggcaccacccccaccagcgugagccagcugugcaagaucagaggcaccaccuaccacgccaccggcggcaacggcaucaaccugaccgagcugaacggcgagcccuaccacgccuucgagagccccgcccccaucggcuuccccgaccugggcggcugcgacuggcaccugaccgccacccccacccaggccuucaacgacggcgccaagguggugagacugagcgugacccagggcgccgccuucgccccccaccugggcaccauccacuacaccaccaccgacaccgacuacaaccccaacaccagcaucaucugcacccuggacuggcugagccagaccgccggccagagcaacguggaccccuggcagauccccaccuacggcagcacccugaccgaggccgcccagcuggccccccccaucuucccccccggcuucggcgagacccugguguucuuccugagcgacuuccccaucagcaacggcaagaacggccugagcgugcccugcacccugccccaggaguucgugacccacuucgugaacgagcaggcccccaucagaggcgaggccgcccugcugcacuacguggaccccgacacccacagaaaccugggcgaguucaagcuguaccccgagggcuucaugaccugcgugcccaacaccagcggcggcggcccccagacccugcccaucaacggcguguucguguucgugagcugggugagcagauucuaccagcugaagcccgugggcaccgccggcgccgccagaagacuguga

SEQ ID NO: 24735 - RNA, 1620 nt, Artificial Sequence
  derived and/or modified sequence opt4 from VP1__Norovirus_and/or_Norovirus-like__GU296356
augaugauggccagcaaggacgccaccagcaacauggacggcaccagcggcgccggccagcuggugcccgagaacaacaacaccagcgagcccaucaacauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccuggcccaccugagccagauguacaacggcugggugggcaacaugaaggugagaguggugcuggccggcaacgccuucagcgccggcaagaucaucgugugcugcaucccccccggcuucagcgcccccaacaucagcaucgcccaggccaccauguucccccacgugaucgccgacgugagagugcuggagcccaucgacaucccccuggacgacgugagaaacgugcuguuccacaccaacgacaacggcaaccagaccaugagacugcugugcaugcuguacaccccccugagaagcggcggcaccagcagcggcaccgaccccuucgugaucgccggcagagugcugaccugccccacccccgacuucaacuuccuguuccuggugccccccaccguggagcagaagaccaagcaguucagcgugcccaaccugccccugaacgugaugagcaacagcagagugcccagccugcugaacgccaugguggugagccccgaccaggcccagguggugcaguuccagaacggcagaugcacccuggacggccagaugcugggcaccaccaccgugagcgccagcugcguggccagauucagaggcaagaccuuccaggcccccgacgacagacugggcaucaaccuggccgagaucagcggcgagcccuaccacgccuucgagagccccgccccccugggcuuccccgacuucggcgacggcgacuggcacgugaccgccaccaagguggcccccagccagcuggaggccaacgaccccgugguggugggcaacgugcagcccuacaacccccaguucgccccccaccugggcacccuggugguggagaaccccacccccaaccagguggccaccggcaccgaccugcuguucaacaucaccuggcugagcaacagagccaacaacagauucaaccccuggaucauccccaacuacggcagcacccugaccgaggccgcccagcuggcccccagcaucuucccccccggcuucggcgagaccaucguguacuucaacagcaccuuccccgccgugggcgccaccacccacgccgccauccccugccugcugccccaggaguucguggcccacuucgugaacgagcaggcccccaucagaggcgaggccgcccugcugcacuacaucgaccccgacacccacagaaaccugggcgaguucaagaucuaccccgagggcuucgugaccugcgugcccaacgugggcggcaccggcccccagagccugcccaccaacggcaucuucguguucgugagcugggugagcagauacuaccagcugaagcccgugggcaccgccuga

SEQ ID NO: 24736 - RNA, 1620 nt, Artificial Sequence
  derived and/or modified sequence opt4 from VP1__Norovirus_and/or_Norovirus-like__KM461693
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaacgccagagccgccgaccugaccgacagcccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagcaccgacuucaccaccaaccagcccaucagauucacccccgugggcaugggcgacaacaacuggagacagugggagcugcccgacuacagcggcagccugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaugggcgugccccccaacggcuacuucagauucgaggccugggugaaccaguucuacacccuggcccccuga

SEQ ID NO: 24737 - RNA, 1620 nt, Artificial Sequence
  derived and/or modified sequence opt4 from VP1__Norovirus_and/or_Norovirus-like__LC145789
augaagauggccagcaacgacgccgcccccagcaccgacggcgccgccggccuggugcccgagagcaacaacgaggugauggcccuggagcccguggccggcgccgcccuggccgcccccgugaccggccagaccaacaucaucgaccccuggaucagagccaacuucgugcaggcccccaacggcgaguucaccgugagccccagaaacagccccggcgaggugcugcugaaccuggagcugggccccgagcugaaccccuaccuggcccaccuggccagaauguacaacggcuacgccggcggcauggaggugcaggugaugcuggccggcaacgccuucaccgccggcaagcugguguucgccgccgugcccccccacuuccccguggagaaccugagcccccagcagaucaccauguucccccacgugaucaucgacgugagaacccuggagcccgugcugcugccccugcccgacgugagaaacaacuucuuccacuacaaccagaaggacgaccccaagaugagaaucguggccaugcuguacaccccccugagaagcaacggcagcggcgacgacguguucaccgugagcugcagagugcugaccagacccagccccgacuucgacuucaccuaccuggugccccccaccguggagagcaagaccaagcccuucacccugcccauccugacccugggcgagcugagcaacagcagauuccccgugagcaucgaccagauguacaccagccccaacgaggugaucagcgugcagugccagaacggcagaugcacccuggacggcgagcugcagggcaccacccagcugcaggugagcggcaucugcgccuucaagggcgaggugaccgcccaccugcacgacaacgaccaccuguacaacgugaccaucaccaaccugaacggcagccccuucgaccccagcgaggacauccccgccccccugggcgugcccgacuuccagggcagaguguucggcgugaucagccagagagacaagcacaacacccccggccacaacgagcccgccaacagagcccacgacgccguggugcccaccuacaccgcccaguacacccccaagcugggccagauccagaucggcaccuggcagaccgacgaccugaccgugaaccagcccgugaaguucacccccgugggccugaacgacaccgaccacuucaaccaguggguggugcccagauacgccggcgcccugaaccugaacaccaaccuggcccccagcguggcccccguguuccccggcgagagacugcuguucuucagaagcuacaucccccugaagggcggcuacggcacccccgccaucgacugccugcugccccaggagugggugcagcacuucuaccaggaggccgcccccagcaugagcgagguggcccuggugagauacaucaaccccgacaccggcagagcccuguucgaggccaagcugcacagagccggcuucaugaccgugagcagcaacaccagcgcccccgugguggugcccgccaacggcuacuucagauucgacagcugggugaaccaguucuacagccuggcccccaugggcaccggcaacggcagaagauga

SEQ ID NO: 24738 - RNA, 1617 nt, Artificial Sequence
  derived and/or modified sequence opt4 from VP1__Norovirus_and/or_Norovirus-like__KX171417
augaagauggccagcaacgacgccgcccccagcaacgacggcgccgccggccuggugcccgagggcaacaacgagacccugagccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccaagaccgaccacagcgacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacgacgacuuccagcugcagcccaccaaguucacccccgugugcaucaacgacgacgacgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgagguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24739 - RNA, 1617 nt, Artificial Sequence
  derived and/or modified sequence opt4 from VP1__Norovirus_and/or_Norovirus-like__KX171412
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccaccacgacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacgacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24740 - RNA, 1617 nt, Artificial Sequence
  derived and/or modified sequence opt4 from VP1__Norovirus_and/or_Norovirus-like__KU557839
augaagauggccagcaacgacgccgcccccagcagcgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24741 - RNA, 1617 nt, Artificial Sequence
  derived and/or modified sequence opt4 from VP1__Norovirus_and/or_Norovirus-like__KP902564
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccgacagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24742 - RNA, 1617 nt, Artificial Sequence
  derived and/or modified sequence opt4 from VP1__Norovirus_and/or_Norovirus-like__KU587625
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccacaucaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgacaaccccgacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagccccaaguucgugcccaagcugggcagcgugaacuucagaagcaacgacgacgacuuccagcugcagcccaccagauucacccccgugggcaucaacgacgacggcaaccaccccuucagacagugggagcugcccgacuacagcggcgugcugacccugaacaugaaccuggccccccccguggcccccaacuuccccggcgagcagcugcugcuguucagaagcuucgugcccugcagcggcggcuacaaccagggcaucaucgacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24743 - RNA, 1617 nt, Artificial Sequence
  derived and/or modified sequence opt4 from VP1__Norovirus_and/or_Norovirus-like__KX171413
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccaccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacgacgacuuccagcugcagcccaccaaguucacccccgugggcaucaacgacgacggcgaccaccccuucagacagugggagcugcccgacuacagcggcccccugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24744 - RNA, 1617 nt, Artificial Sequence
  derived and/or modified sequence opt4 from VP1__Norovirus_and/or_Norovirus-like__KP902565
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24745 - RNA, 1617 nt, Artificial Sequence
  derived and/or modified sequence opt4 from VP1__Norovirus_and/or_Norovirus-like__KX171416
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacaacagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcaucgccagccagagaaacgugggcaacgacgcccccggcagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24746 - RNA, 1617 nt, Artificial Sequence
  derived and/or modified sequence opt4 from VP1__Norovirus_and/or_Norovirus-like__KU561250
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccagaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgccaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaagagcccaguga

SEQ ID NO: 24747 - RNA, 1617 nt, Artificial Sequence
  derived and/or modified sequence opt4 from VP1__Norovirus_and/or_Norovirus-like__KU561251
augaagauggccagcaacgacgccgcccccagcaacgacggcgccgccggccuggugcccgagggcaacaacgagacccugccccuggagcccguggccggcgccgccaucgccgcccccgugaccggccagaacaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccgugccccccaacuuccccguggaguuccugagccccgcccagaucaccaugcugccccaccugaucguggacgugagaacccuggagcccaucaugaucccccugcccgacgugagaaacaccuucuuccacuacaacaaccagcccaacagcagaaugagacugguggccaugcuguacaccccccugagaagcaacggcagcggcgacgacguguucaccgugagcugcagagugcugaccagacccacccccgacuucgaguucaccuaccuggugccccccagcguggagagcaagaccaagcccuucagccugcccauccugacccugagcgagcugaccaacagcagauuccccgugcccaucgacagccuguucaccgcccacaacaacgugcugcaggugcagugccagaacggcagaugcacccuggacggcgagcugcagggcaccacccagcugcugcccagcggcaucugcgccuucagaggcagagugaccgccgagaccgaccacagagacaaguggcacaugcagcugcagaaccugaacggcaccaccuacgaccccaccgacgacgugcccgccccccugggcacccccgacuucaagggcgugguguucggcguggccagccagagaaacgugggcaacgacgcccccggcagcaccagagcccacgaggccgugaucagcaccuacagcccccaguucgugcccaagcugggcagcgugaacuucagaagcaacgacaacgacuuccagcugcagcccaccaaguucacccccgugggcaucaacgacgacggcgaccaccccuucagacagugggagcugcccgacuacagcggccugcugacccugaacaugaaccuggccccccccguggcccccaacuuccccggcgagcagcugcuguucuucagaagcuucgugcccugcagcggcggcuacaaccagggcaucguggacugccugaucccccaggaguggauccagcacuucuaccaggagagcgcccccagccagagcgacguggcccugaucagauacgugaaccccgacaccggcagaacccuguucgaggccaagcugcacagaagcggcuacaucaccguggcccacagcggcgacuacccccugguggugcccgccaacggcuacuucagauucgacagcugggugaaccaguucuacagccuggcccccaugggcaccggcaacggcagaagaaccgcccaguga

SEQ ID NO: 24748 - RNA, 1617 nt, Artificial Sequence
  derived and/or modified sequence opt4 from VP1__Norovirus_and/or_Norovirus-like__AB810014
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagaggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagauga

SEQ ID NO: 24749 - RNA, 1617 nt, Artificial Sequence
  derived and/or modified sequence opt4 from VP1__Norovirus_and/or_Norovirus-like__AB809985
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagauga

SEQ ID NO: 24750 - RNA, 1617 nt, Artificial Sequence
  derived and/or modified sequence opt4 from VP1__Norovirus_and/or_Norovirus-like__AB810003
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagaggcgacaacugggaccagaaccugcugcagcugaccuaccccagcggcgccagcuacgaccccaccgacgaggugcccgccccccugggcacccaggacuucagcggcauccuguacggcgugcugacccaggacaacgugagcgagggcaccggcgaggccaagaacgccaagggcguguacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugagaggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugguucaaccaguucuacagccuggcccccaugggcaccggcaacggcagauga

SEQ ID NO: 24751 - RNA, 1617 nt, Artificial Sequence
  derived and/or modified sequence opt4 from VP1__Norovirus_and/or_Norovirus-like__AB809975
augaagauggccagcaacgacgccgcccccagcaacgacggcgccgccagccuggugcccgaggccaucaacgagaccaugccccuggagcccguggccggcgccagcaucgccgcccccguggccggccagaccaacaucaucgaccccuggaucagaaccaacuucgugcaggcccccaacggcgaguucaccgugagccccagaaacagccccggcgagauccugcugaaccuggagcugggccccgaccugaaccccuaccuggcccaccugagcagaauguacaacggcuacgccggcggcguggaggugcaggugcugcuggccggcaacgccuucaccgccggcaagauccuguucgccgccaucccccccaacuuccccguggacaugaucagccccgcccagaucaccaugcugccccaccugaucguggacgugagaacccuggagcccaucaugaucccccugcccgacgugagaaacguguucuaccacuucaacaaccagccccagcccagaaugagacugguggccaugcuguacaccccccugagaagcaacggcagcggcgacgacguguucaccgugagcugcagagugcugaccagacccacccccgacuucgaguucaucuaccuggugccccccagcguggagagcaagaccaagcccuucacccugcccauccugaccaucagcgagcugaccaacagcagauuccccauccccaucgagcagcuguacaccgcccccaacgagaacaacguggugcagugccagaacggcagaugcacccuggacggcgagcugcagggcaccacccagcugcugagcagcgccgugugcagcuacagaggcagaaccguggccaacagcggcgacaacugggaccagaaccugcugcagcugagcuaccccagcggcgccagcuacgaccccaccgacgaggugcccgccccccugggcacccaggacuucagcggcauccuguacggcgugcugacccaggacaacgugagcgagagaaccggcgaggccaagaacgccaagggcaucuacaucagcaccaccagcggcaaguucacccccaagaucggcagcaucggccugcacagcaucaccgagaacgugcaccccaaccagcagagcagauucacccccgugggcguggcccagaacgagaacacccccuuccagcagugggugcugccccacuacgccggcgcccuggcccugaacaccaaccuggcccccgccguggcccccaccuuccccggcgagcagcugcuguucuucagaagcagagugcccugcgugcagggccugcagggccaggacgccuucaucgacugccugcugccccaggagugggugaaccacuucuaccaggaggccgcccccagccaggccgacguggcccugaucagauacgugaaccccgacaccggcagaacccuguucgaggccaagcugcacagaagcggcuucaucaccgugagccacaccggcgccuacccccugguggugccccccaacggccacuucagauucgacagcugggugaaccaguucuacagccuggcccccaugggcaccggcaacggcagauga

SEQ ID NO: 24752 - RNA, 1617 nt, Artificial Sequence
  derived and/or modified sequence opt4 from VP1__Norovirus_and/or_Norovirus-like__JX401280
augaagauggccagcagcgacgccaaccccagcgacggcagcagcgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugagccccgaccugaaccccuaccugagccaccugagcagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggccaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagagacuguucaccggccccagcaccgccuucguggugcagccccagaacggcagaugcaccaccgacggcgugcugcugggcaccacccagcugagcgccgugaacaucugcaacuucagaggcgaggugaaccacaucgccggcacccacgacuacaccaugagacugaccagccagaacuggaacaacuacgaccccaccgaggagauccccgccccccugggcacccccgacuucgugggcagaauccagggcgugcugacccagaccaccagaagcgacggcagcaccagaagccacaaggccaccgugagcaccggcagcgugcacuucacccccaagcugggcagcgugcaguucaccaccgacaccaccaacgaccugaacgccggccagaacaccaaguucacccccgugggcguggagcagaccagcggcgaccaccagagcgagccccagcaguggacccugcccaacuacagcggcacccccaaccacaacgugcaccuggcccccgccguggcccccaccuuccccggcgagcagcugcuguucuucagaagcacccugcccggcugcggcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacagaagcggcuucaucaccguggcccacagcggcagccacgaccuggugaucccccccaacggcuacuucagauucgacagcugggugaaccaguucuacacccuggcccccaugggcaacggcagcggcagaagaagaguguga

SEQ ID NO: 24753 - RNA, 1617 nt, Artificial Sequence
  derived and/or modified sequence opt4 from VP1__Norovirus_and/or_Norovirus-like__KC962462
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagagccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucgccggcacccacaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaggccacaaggccaccgugugcaucggcagcgccgacuucgcccccaagcugggcagagugcaguucgagaccgacaccaacaacgaccuggagaccaaccagaacaccaaguucacccccgugggcgugauccagaacggcgagaccgcccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcagccacgaccuggugaucccccccaacggcuacuucagauucgacagcugggugaaccaguucuacacccuggcccccaugggcaacggcaccggcagaagaagauga

SEQ ID NO: 24754 - RNA, 1617 nt, Artificial Sequence
  derived and/or modified sequence opt4 from VP1__Norovirus_and/or_Norovirus-like__KX353974
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagauccaccagaacaccagauucacccccgugggcgugauccaggacggcagcaccacccacagaaacgagccccagcagugggugcugcccagcuacagcggcagaagcgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24755 - RNA, 1617 nt, Artificial Sequence
  derived and/or modified sequence opt4 from VP1__Norovirus_and/or_Norovirus-like__KF060122
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucgcccccaagcugggcagagugcaguucgccaccgacaccaacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24756 - RNA, 1617 nt, Artificial Sequence
  derived and/or modified sequence opt4 from VP1__Norovirus_and/or_Norovirus-like__KR904234
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacagcgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcagcuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacagagccaccguguacaccggcagcgccgacuucagccccaagcugggcagagugcaguucgccaccgacaccgacaacgacuucguggccaaccagaacaccaaguucacccccgugggcgugauccaggacggcgacaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24757 - RNA, 1617 nt, Artificial Sequence
  derived and/or modified sequence opt4 from VP1__Norovirus_and/or_Norovirus-like__KR131769
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccaucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24758 - RNA, 1617 nt, Artificial Sequence
  derived and/or modified sequence opt4 from VP1__Norovirus_and/or_Norovirus-like__KR131764
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccagcagcagaaacuacaccaugaaccuggccagccagaacuggaacaacuacgaccccaccgaggagauccccgccccccugggcacccccgacuucgugggcaagauccagggcaugcugacccagaccaccaagagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24759 - RNA, 1617 nt, Artificial Sequence
  derived and/or modified sequence opt4 from VP1__Norovirus_and/or_Norovirus-like__GU390901
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24760 - RNA, 1617 nt, Artificial Sequence
  derived and/or modified sequence opt4 from VP1__Norovirus_and/or_Norovirus-like__EU078408
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccagacccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugagccagaccaccagaggcgacggcagcaccagaggccacaaggccaccgugagcaccggcagcgugcacuucacccccaagcugggcagcgugcaguucaccaccgacaccaacaacgaccuggagaccggccagaacaccaaguucacccccgugggcguggugcaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24761 - RNA, 1617 nt, Artificial Sequence
  derived and/or modified sequence opt4 from VP1__Norovirus_and/or_Norovirus-like__AB933676
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24762 - RNA, 1617 nt, Artificial Sequence
  derived and/or modified sequence opt4 from VP1__Norovirus_and/or_Norovirus-like__KX354082
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagagagacggcagcaccagaggccacaaggccaccguguacaccggcagcgccgacuucacccccaagcugggcagcgugcaguucggcaccgacaccgagaacgacuucgagacccaccagaacaccagauucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24763 - RNA, 1617 nt, Artificial Sequence
  derived and/or modified sequence opt4 from VP1__Norovirus_and/or_Norovirus-like__KJ407076
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagaguguga

SEQ ID NO: 24764 - RNA, 1617 nt, Artificial Sequence
  derived and/or modified sequence opt4 from VP1__Norovirus_and/or_Norovirus-like__JX459636
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24765 - RNA, 1617 nt, Artificial Sequence
  derived and/or modified sequence opt4 from VP1__Norovirus_and/or_Norovirus-like__JX445161
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24766 - RNA, 1617 nt, Artificial Sequence
  derived and/or modified sequence opt4 from VP1__Norovirus_and/or_Norovirus-like__EU876888
augaagauggccagcagcgacgccagccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaggcgacggcagcaccagaggccacaaggccaccguguacaccggcagcgccgacuucgcccccaagcugggcagagugcaguucgccaccgacaccgacaacgacuucgagagcaaccagaacaccaaguucacccccgugggcgugauccaggacggcaacaccacccacagaaacgagccccagcagugggugcugcccggcuacagcggcagagacggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24767 - RNA, 1617 nt, Artificial Sequence
  derived and/or modified sequence opt4 from VP1__Norovirus_and/or_Norovirus-like__EU839584
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccaagagagacggcagcaccagaggccacaaggccaccgugagcaccggcagcgugcacuucacccccaagcugggcagcgugcaguucagcaccgacaccagcaacgacuucgagaucggccagaacaccagauucacccccgugggcguggugcaggacggcagcaccacccaccagaacgagccccagcagugggugcugcccaacuacagcggcagagacggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagcccuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24768 - RNA, 1617 nt, Artificial Sequence
  derived and/or modified sequence opt4 from VP1__Norovirus_and/or_Norovirus-like__KX354090
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccagauucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24769 - RNA, 1617 nt, Artificial Sequence
  derived and/or modified sequence opt4 from VP1__Norovirus_and/or_Norovirus-like__KF060124
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccaacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24770 - RNA, 1617 nt, Artificial Sequence
  derived and/or modified sequence opt4 from VP1__Norovirus_and/or_Norovirus-like__JX439826
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24771 - RNA, 1617 nt, Artificial Sequence
  derived and/or modified sequence opt4 from VP1__Norovirus_and/or_Norovirus-like__JX439815
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24772 - RNA, 1617 nt, Artificial Sequence
  derived and/or modified sequence opt4 from VP1__Norovirus_and/or_Norovirus-like__KC576912
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgacaacgacuucgagacccaccagaacaccagauucacccccgugggcgugauccaggacggcgccaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24773 - RNA, 1617 nt, Artificial Sequence
  derived and/or modified sequence opt4 from VP1__Norovirus_and/or_Norovirus-like__GQ845368
augaagauggccagcagcgacgccagccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaggcgacggcagcaccagaggccacaaggccaccguguacaccggcagcgccgacuucgcccccaagcugggcagagugcaguucgccaccgacaccgacaacgacuucgagagcaaccagaacaccaaguucacccccgugggcgugauccaggacggcaacaccacccaccagaacgagccccagcagugggugcugcccggcuacagcggcagagacggccacaacgugcaccuggcccccgccguggcccccaccuaccccggcgagcagcugcuguucuucagaagcaccaugcccggcugcagcggcuaccccaacaugaaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24774 - RNA, 1617 nt, Artificial Sequence
  derived and/or modified sequence opt4 from VP1__Norovirus_and/or_Norovirus-like__AB541249
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24775 - RNA, 1617 nt, Artificial Sequence
  derived and/or modified sequence opt4 from VP1__Norovirus_and/or_Norovirus-like__EU078412
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgaccuggagaccggccagaacaccagauucacccccgugggcguggugcaggacggcaacagcacccaccagaacgagccccagcagugggugcugcccaacuacagcggcagagccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24776 - RNA, 1617 nt, Artificial Sequence
  derived and/or modified sequence opt4 from VP1__Norovirus_and/or_Norovirus-like__AB445395
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24777 - RNA, 1617 nt, Artificial Sequence
  derived and/or modified sequence opt4 from VP1__Norovirus_and/or_Norovirus-like__AB933655
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24778 - RNA, 1617 nt, Artificial Sequence
  derived and/or modified sequence opt4 from VP1__Norovirus_and/or_Norovirus-like__KM245072
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24779 - RNA, 1617 nt, Artificial Sequence
  derived and/or modified sequence opt4 from VP1__Norovirus_and/or_Norovirus-like__AB541282
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24780 - RNA, 1617 nt, Artificial Sequence
  derived and/or modified sequence opt4 from VP1__Norovirus_and/or_Norovirus-like__AB541202
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24781 - RNA, 1617 nt, Artificial Sequence
  derived and/or modified sequence opt4 from VP1__Norovirus_and/or_Norovirus-like__FJ514242
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24782 - RNA, 1617 nt, Artificial Sequence
  derived and/or modified sequence opt4 from VP1__Norovirus_and/or_Norovirus-like__KX353976
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacaucagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgacaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24783 - RNA, 1617 nt, Artificial Sequence
  derived and/or modified sequence opt4 from VP1__Norovirus_and/or_Norovirus-like__KX353952
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccagauucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24784 - RNA, 1617 nt, Artificial Sequence
  derived and/or modified sequence opt4 from VP1__Norovirus_and/or_Norovirus-like__KR131771
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24785 - RNA, 1617 nt, Artificial Sequence
  derived and/or modified sequence opt4 from VP1__Norovirus_and/or_Norovirus-like__AB933729
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaucguguacaccggcagcgccgacuucgcccccaagcugggcagagugcaguucgccaccgacaccgacaacgacuucggcgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24786 - RNA, 1617 nt, Artificial Sequence
  derived and/or modified sequence opt4 from VP1__Norovirus_and/or_Norovirus-like__AB933646
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24787 - RNA, 1617 nt, Artificial Sequence
  derived and/or modified sequence opt4 from VP1__Norovirus_and/or_Norovirus-like__JX155742
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24788 - RNA, 1617 nt, Artificial Sequence
  derived and/or modified sequence opt4 from VP1__Norovirus_and/or_Norovirus-like__JN400614
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccagcuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24789 - RNA, 1617 nt, Artificial Sequence
  derived and/or modified sequence opt4 from VP1__Norovirus_and/or_Norovirus-like__JN400601
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcaacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 24790 - RNA, 1617 nt, Artificial Sequence
  derived and/or modified sequence opt4 from VP1__Norovirus_and/or_Norovirus-like__JQ613538
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagaauccaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcacccugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24791 - RNA, 1617 nt, Artificial Sequence
  derived and/or modified sequence opt4 from VP1__Norovirus_and/or_Norovirus-like__HM802543
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcgacaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24792 - RNA, 1617 nt, Artificial Sequence
  derived and/or modified sequence opt4 from VP1__Norovirus_and/or_Norovirus-like__AB541337
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24793 - RNA, 1617 nt, Artificial Sequence
  derived and/or modified sequence opt4 from VP1__Norovirus_and/or_Norovirus-like__AB541252
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24794 - RNA, 1617 nt, Artificial Sequence
  derived and/or modified sequence opt4 from VP1__Norovirus_and/or_Norovirus-like__GU270580
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagaauccaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24795 - RNA, 1617 nt, Artificial Sequence
  derived and/or modified sequence opt4 from VP1__Norovirus_and/or_Norovirus-like__EU876882
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24796 - RNA, 1617 nt, Artificial Sequence
  derived and/or modified sequence opt4 from VP1__Norovirus_and/or_Norovirus-like__AB933649
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcggcaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24797 - RNA, 1617 nt, Artificial Sequence
  derived and/or modified sequence opt4 from VP1__Norovirus_and/or_Norovirus-like__JX439816
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24798 - RNA, 1617 nt, Artificial Sequence
  derived and/or modified sequence opt4 from VP1__Norovirus_and/or_Norovirus-like__JX155739
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24799 - RNA, 1617 nt, Artificial Sequence
  derived and/or modified sequence opt4 from VP1__Norovirus_and/or_Norovirus-like__HQ456338
augaagauggccagcaacgacgccagccccagcgacggcagcgccgccaaccuggugcccgaggugaacaacgaggugauggcccuggagcccguggugggcgccgccaucgccgcccccguggccggccagaagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24800 - RNA, 1617 nt, Artificial Sequence
  derived and/or modified sequence opt4 from VP1__Norovirus_and/or_Norovirus-like__AB541359
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgagguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24801 - RNA, 1617 nt, Artificial Sequence
  derived and/or modified sequence opt4 from VP1__Norovirus_and/or_Norovirus-like__AB541280
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccgcccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24802 - RNA, 1617 nt, Artificial Sequence
  derived and/or modified sequence opt4 from VP1__Norovirus_and/or_Norovirus-like__AB541244
augaagauggccagcaacgacgccaaccccagcgacggcagcgccgccaaccuggugcccgaggugaacaacgagggcauggcccuggagcccguggugggcgccgccaucgccgcccccguggccggccagaccaacgugaucgaccccuggaucagaaacaacuucgugcaggcccccggcggcgaguucaccgugagccccagaaacgcccccagcgagauccuguggagcgccagccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcaacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaagcgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24803 - RNA, 1617 nt, Artificial Sequence
  derived and/or modified sequence opt4 from VP1__Norovirus_and/or_Norovirus-like__AB541203
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgugggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24804 - RNA, 1617 nt, Artificial Sequence
  derived and/or modified sequence opt4 from VP1__Norovirus_and/or_Norovirus-like__GQ850882
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccguguucaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24805 - RNA, 1617 nt, Artificial Sequence
  derived and/or modified sequence opt4 from VP1__Norovirus_and/or_Norovirus-like__KR131772
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24806 - RNA, 1617 nt, Artificial Sequence
  derived and/or modified sequence opt4 from VP1__Norovirus_and/or_Norovirus-like__KR904215
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccacccagaacuggagcagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgccaccgacaccgacaacgacuucgaggccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 24807 - RNA, 1617 nt, Artificial Sequence
  derived and/or modified sequence opt4 from VP1__Norovirus_and/or_Norovirus-like__AB933715
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24808 - RNA, 1617 nt, Artificial Sequence
  derived and/or modified sequence opt4 from VP1__Norovirus_and/or_Norovirus-like__AB933695
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24809 - RNA, 1617 nt, Artificial Sequence
  derived and/or modified sequence opt4 from VP1__Norovirus_and/or_Norovirus-like__AB933681
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacgccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24810 - RNA, 1617 nt, Artificial Sequence
  derived and/or modified sequence opt4 from VP1__Norovirus_and/or_Norovirus-like__AB933675
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccaacagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24811 - RNA, 1617 nt, Artificial Sequence
  derived and/or modified sequence opt4 from VP1__Norovirus_and/or_Norovirus-like__AB933652
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24812 - RNA, 1617 nt, Artificial Sequence
  derived and/or modified sequence opt4 from VP1__Norovirus_and/or_Norovirus-like__KF429762
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24813 - RNA, 1617 nt, Artificial Sequence
  derived and/or modified sequence opt4 from VP1__Norovirus_and/or_Norovirus-like__JX644027
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcaagaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24814 - RNA, 1617 nt, Artificial Sequence
  derived and/or modified sequence opt4 from VP1__Norovirus_and/or_Norovirus-like__JN400617
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24815 - RNA, 1617 nt, Artificial Sequence
  derived and/or modified sequence opt4 from VP1__Norovirus_and/or_Norovirus-like__JQ613519
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24816 - RNA, 1617 nt, Artificial Sequence
  derived and/or modified sequence opt4 from VP1__Norovirus_and/or_Norovirus-like__HQ456341
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcguguuccugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24817 - RNA, 1617 nt, Artificial Sequence
  derived and/or modified sequence opt4 from VP1__Norovirus_and/or_Norovirus-like__HM802540
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcagcugagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24818 - RNA, 1617 nt, Artificial Sequence
  derived and/or modified sequence opt4 from VP1__Norovirus_and/or_Norovirus-like__AB541257
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgcccagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24819 - RNA, 1617 nt, Artificial Sequence
  derived and/or modified sequence opt4 from VP1__Norovirus_and/or_Norovirus-like__AB541242
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24820 - RNA, 1617 nt, Artificial Sequence
  derived and/or modified sequence opt4 from VP1__Norovirus_and/or_Norovirus-like__AB541225
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccggcgacgacuuccagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24821 - RNA, 1617 nt, Artificial Sequence
  derived and/or modified sequence opt4 from VP1__Norovirus_and/or_Norovirus-like__AB541190
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacauggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24822 - RNA, 1617 nt, Artificial Sequence
  derived and/or modified sequence opt4 from VP1__Norovirus_and/or_Norovirus-like__AB492092
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24823 - RNA, 1617 nt, Artificial Sequence
  derived and/or modified sequence opt4 from VP1__Norovirus_and/or_Norovirus-like__EU916956
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccaaguucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24824 - RNA, 1617 nt, Artificial Sequence
  derived and/or modified sequence opt4 from VP1__Norovirus_and/or_Norovirus-like__EF126962
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucagacugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggaggugcccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24825 - RNA, 1617 nt, Artificial Sequence
  derived and/or modified sequence opt4 from VP1__Norovirus_and/or_Norovirus-like__AB663687
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcaguuccuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24826 - RNA, 1617 nt, Artificial Sequence
  derived and/or modified sequence opt4 from VP1__Norovirus_and/or_Norovirus-like__AB933759
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24827 - RNA, 1617 nt, Artificial Sequence
  derived and/or modified sequence opt4 from VP1__Norovirus_and/or_Norovirus-like__AB933755
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24828 - RNA, 1617 nt, Artificial Sequence
  derived and/or modified sequence opt4 from VP1__Norovirus_and/or_Norovirus-like__AB933677
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24829 - RNA, 1617 nt, Artificial Sequence
  derived and/or modified sequence opt4 from VP1__Norovirus_and/or_Norovirus-like__AB933650
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24830 - RNA, 1617 nt, Artificial Sequence
  derived and/or modified sequence opt4 from VP1__Norovirus_and/or_Norovirus-like__KM245071
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24831 - RNA, 1617 nt, Artificial Sequence
  derived and/or modified sequence opt4 from VP1__Norovirus_and/or_Norovirus-like__KF712497
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggagcaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcauccaguucgccaccgacaccgagaacgacuucgagacccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24832 - RNA, 1617 nt, Artificial Sequence
  derived and/or modified sequence opt4 from VP1__Norovirus_and/or_Norovirus-like__KC990829
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacaccgaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24833 - RNA, 1617 nt, Artificial Sequence
  derived and/or modified sequence opt4 from VP1__Norovirus_and/or_Norovirus-like__JX439843
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugccccccgugaacaucugcaccuucagaggcgacgugacccacaucgccggcagcagaguguacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgcccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24834 - RNA, 1617 nt, Artificial Sequence
  derived and/or modified sequence opt4 from VP1__Norovirus_and/or_Norovirus-like__JX439841
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24835 - RNA, 1617 nt, Artificial Sequence
  derived and/or modified sequence opt4 from VP1__Norovirus_and/or_Norovirus-like__JX439830
augaagaugggcagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24836 - RNA, 1617 nt, Artificial Sequence
  derived and/or modified sequence opt4 from VP1__Norovirus_and/or_Norovirus-like__JX439828
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24837 - RNA, 1617 nt, Artificial Sequence
  derived and/or modified sequence opt4 from VP1__Norovirus_and/or_Norovirus-like__JX445153
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcgcccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24838 - RNA, 1617 nt, Artificial Sequence
  derived and/or modified sequence opt4 from VP1__Norovirus_and/or_Norovirus-like__JX155754
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgcccaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24839 - RNA, 1617 nt, Artificial Sequence
  derived and/or modified sequence opt4 from VP1__Norovirus_and/or_Norovirus-like__JN400608
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24840 - RNA, 1617 nt, Artificial Sequence
  derived and/or modified sequence opt4 from VP1__Norovirus_and/or_Norovirus-like__EF187497
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccaucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugaacuucacccccaagcugggcagaauccaguucagcaccgacaccagcaacgacuucgagaccggccagagcaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24841 - RNA, 1617 nt, Artificial Sequence
  derived and/or modified sequence opt4 from VP1__Norovirus_and/or_Norovirus-like__AB668028
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24842 - RNA, 1617 nt, Artificial Sequence
  derived and/or modified sequence opt4 from VP1__Norovirus_and/or_Norovirus-like__HM802542
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24843 - RNA, 1617 nt, Artificial Sequence
  derived and/or modified sequence opt4 from VP1__Norovirus_and/or_Norovirus-like__HQ009513
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24844 - RNA, 1617 nt, Artificial Sequence
  derived and/or modified sequence opt4 from VP1__Norovirus_and/or_Norovirus-like__AB541322
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccaccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24845 - RNA, 1617 nt, Artificial Sequence
  derived and/or modified sequence opt4 from VP1__Norovirus_and/or_Norovirus-like__AB541321
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagcccccagaacgcccccagcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24846 - RNA, 1617 nt, Artificial Sequence
  derived and/or modified sequence opt4 from VP1__Norovirus_and/or_Norovirus-like__AB541253
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24847 - RNA, 1617 nt, Artificial Sequence
  derived and/or modified sequence opt4 from VP1__Norovirus_and/or_Norovirus-like__AB541250
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24848 - RNA, 1617 nt, Artificial Sequence
  derived and/or modified sequence opt4 from VP1__Norovirus_and/or_Norovirus-like__AB541211
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24849 - RNA, 1617 nt, Artificial Sequence
  derived and/or modified sequence opt4 from VP1__Norovirus_and/or_Norovirus-like__GQ246797
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24850 - RNA, 1617 nt, Artificial Sequence
  derived and/or modified sequence opt4 from VP1__Norovirus_and/or_Norovirus-like__GQ246794
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24851 - RNA, 1617 nt, Artificial Sequence
  derived and/or modified sequence opt4 from VP1__Norovirus_and/or_Norovirus-like__EU876884
augaagauggccagcaacgacgccaaccccagcgacggcagcaccgccaaccuggugcccgaggugaacagcgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccagcuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24852 - RNA, 1617 nt, Artificial Sequence
  derived and/or modified sequence opt4 from VP1__Norovirus_and/or_Norovirus-like__FJ411170
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgacuucgagaccggccagaacaccaaguucacccccgugggcguggugcaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24853 - RNA, 1617 nt, Artificial Sequence
  derived and/or modified sequence opt4 from VP1__Norovirus_and/or_Norovirus-like__EU839589
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagaaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24854 - RNA, 1617 nt, Artificial Sequence
  derived and/or modified sequence opt4 from VP1__Norovirus_and/or_Norovirus-like__KX353961
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24855 - RNA, 1617 nt, Artificial Sequence
  derived and/or modified sequence opt4 from VP1__Norovirus_and/or_Norovirus-like__AB933757
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaccccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcagguggccaccgacaccaacaacgacuucgacgccaaccagaacaccaaguucacccccgugggcgugauccaggacggcggcaccacccacagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24856 - RNA, 1617 nt, Artificial Sequence
  derived and/or modified sequence opt4 from VP1__Norovirus_and/or_Norovirus-like__KM245074
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24857 - RNA, 1617 nt, Artificial Sequence
  derived and/or modified sequence opt4 from VP1__Norovirus_and/or_Norovirus-like__EU921368
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugaccaacaucgccggcagccagaccuacaccaugaaccuggccagccagaacuggaacaacuacgaccccaccgaggagauccccgccccccugggcacccccgacuucgugggcaagauccagggcgugcugacccagaccaccaagggcgacggcagcaccagaggccacaaggccaccgugagcaccggcagcgcccaguucacccccaagcugggcagcgugcaguucagcaccgacaccagcaccgacuucgagaccggccagaacaccagauucacccccgugggcgugauccaggacggcagcaccacccacaagaacgagccccagcagugggugcugcccagcuacagcggcagagacagccacaacgugcaccuggcccccgccguggcccccaccuuccccggcgagcagauccuguucuucagaagcaccaugcccggcugcagcggcuaccccaacauggaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24858 - RNA, 1617 nt, Artificial Sequence
  derived and/or modified sequence opt4 from VP1__Norovirus_and/or_Norovirus-like__EU921338
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgccuacagcggcagagacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24859 - RNA, 1617 nt, Artificial Sequence
  derived and/or modified sequence opt4 from VP1__Norovirus_and/or_Norovirus-like__LC005708
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24860 - RNA, 1617 nt, Artificial Sequence
  derived and/or modified sequence opt4 from VP1__Norovirus_and/or_Norovirus-like__LC005704
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24861 - RNA, 1617 nt, Artificial Sequence
  derived and/or modified sequence opt4 from VP1__Norovirus_and/or_Norovirus-like__KF429777
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggagcaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24862 - RNA, 1617 nt, Artificial Sequence
  derived and/or modified sequence opt4 from VP1__Norovirus_and/or_Norovirus-like__JX439840
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcauccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24863 - RNA, 1617 nt, Artificial Sequence
  derived and/or modified sequence opt4 from VP1__Norovirus_and/or_Norovirus-like__JX644026
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24864 - RNA, 1617 nt, Artificial Sequence
  derived and/or modified sequence opt4 from VP1__Norovirus_and/or_Norovirus-like__JX459906
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24865 - RNA, 1617 nt, Artificial Sequence
  derived and/or modified sequence opt4 from VP1__Norovirus_and/or_Norovirus-like__JX459597
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccugugccacgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccacccugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24866 - RNA, 1617 nt, Artificial Sequence
  derived and/or modified sequence opt4 from VP1__Norovirus_and/or_Norovirus-like__HQ456334
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucaacaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24867 - RNA, 1617 nt, Artificial Sequence
  derived and/or modified sequence opt4 from VP1__Norovirus_and/or_Norovirus-like__HM802553
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugguggccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugaccaacauccccggcagcagaaccuacagaaugaaccuggccagccagaacuggaacaacuacgaccccaccgaggagauccccgccccccugggcacccccgacuucgugggcaagauccagggcgugcugacccagaccaccaagggcgacggcagcaccagaggccacaaggccaccgugagaaccggcagcgccgacuucacccccaagcugggcagcgugcaguucgccaccgacaccgacaacgacuucgugaccggccagaacaccagauucacccccgugggcgugauccacgacggcagcagcgcccacagaaacgagccccagcagugggugcugcccgaguacagcggcagaagcgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24868 - RNA, 1617 nt, Artificial Sequence
  derived and/or modified sequence opt4 from VP1__Norovirus_and/or_Norovirus-like__HQ008055
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacagagccaccguguacaccggcagcgccgaguucgcccccaagcugggcagagugcaguucgccaccgacaccgagaacgacuucgacaccaaccagaacaccaaguucacccccgugggcgugauccaggacggcaacaccacccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaaccuggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24869 - RNA, 1617 nt, Artificial Sequence
  derived and/or modified sequence opt4 from VP1__Norovirus_and/or_Norovirus-like__AB541360
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 24870 - RNA, 1617 nt, Artificial Sequence
  derived and/or modified sequence opt4 from VP1__Norovirus_and/or_Norovirus-like__AB541262
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacguggccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24871 - RNA, 1617 nt, Artificial Sequence
  derived and/or modified sequence opt4 from VP1__Norovirus_and/or_Norovirus-like__AB541231
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucgccgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24872 - RNA, 1617 nt, Artificial Sequence
  derived and/or modified sequence opt4 from VP1__Norovirus_and/or_Norovirus-like__GQ246792
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucacccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24873 - RNA, 1617 nt, Artificial Sequence
  derived and/or modified sequence opt4 from VP1__Norovirus_and/or_Norovirus-like__AB504329
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24874 - RNA, 1617 nt, Artificial Sequence
  derived and/or modified sequence opt4 from VP1__Norovirus_and/or_Norovirus-like__AB504306
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaagagcagauuccccaucccccuggagaagcuguacaccggccccagcagcgccuucguggugcagccccagaacggcagaugcaccaccgacggcgugcugcugggcaccacccagcugagcguggugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagauuccuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagaguguga

SEQ ID NO: 24875 - RNA, 1617 nt, Artificial Sequence
  derived and/or modified sequence opt4 from VP1__Norovirus_and/or_Norovirus-like__GQ303445
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgaccacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24876 - RNA, 1617 nt, Artificial Sequence
  derived and/or modified sequence opt4 from VP1__Norovirus_and/or_Norovirus-like__EU839588
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccuggccguggaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24877 - RNA, 1617 nt, Artificial Sequence
  derived and/or modified sequence opt4 from VP1__Norovirus_and/or_Norovirus-like__DQ364459
augaagauggccagcaacgacgccagcagcagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgacuucgagaccggccagaacaccaaguucacccccgugggcguggugcaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24878 - RNA, 1617 nt, Artificial Sequence
  derived and/or modified sequence opt4 from VP1__Norovirus_and/or_Norovirus-like__KY628449
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugagccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgacuucgccgugcagccccagaacggcagaugcaccaccgacggcgugcugcugggcaccacccagcugagccccgugaacaucugcaccuucagaggcgacgugacccacaucaacggcagcagcaacuacaagaugaaccuggccaaccagaacuggagcaacuacgaccccaccgaggagauccccgccccccugggcgcccccgacuucgugggcaagauccagggcgugcugacccagaccaccaaggaggacggcagcaccagaggccacaaggccaccguguacaccggcagcgccgacuucgcccccaagcugggcagagugcaguucgagaccgacaccgaccacgaccuggagaucgaccagaacaccaaguucacccccgugggcgugauccagaacggcggcaccacccacagaaacgagcccaagcaguggaugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacagcggccagcacgaccugguggugccccccaacggcuacuucagauucgacagcugggugaaccaguucuacacccuggcccccaugggcaacggcagcggcagaagaagauga

SEQ ID NO: 24879 - RNA, 1617 nt, Artificial Sequence
  derived and/or modified sequence opt4 from VP1__Norovirus_and/or_Norovirus-like__KX371608
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaucaccaagggcgacggcagcaccagaggccacaaggccaccguguacaccggcagcgccgacuucacccccaagcugggcagcgugcaguucgccaccgacaccgagaacgacuuccagacccaccagaacaccagauucacccccgugggcgugauccaggacggcggcaccacccaccagaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24880 - RNA, 1617 nt, Artificial Sequence
  derived and/or modified sequence opt4 from VP1__Norovirus_and/or_Norovirus-like__KX354089
augaagauggccagcaacgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24881 - RNA, 1617 nt, Artificial Sequence
  derived and/or modified sequence opt4 from VP1__Norovirus_and/or_Norovirus-like__KX354001
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24882 - RNA, 1617 nt, Artificial Sequence
  derived and/or modified sequence opt4 from VP1__Norovirus_and/or_Norovirus-like__KX353971
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24883 - RNA, 1617 nt, Artificial Sequence
  derived and/or modified sequence opt4 from VP1__Norovirus_and/or_Norovirus-like__KR131766
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24884 - RNA, 1617 nt, Artificial Sequence
  derived and/or modified sequence opt4 from VP1__Norovirus_and/or_Norovirus-like__AB663685
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagagccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24885 - RNA, 1617 nt, Artificial Sequence
  derived and/or modified sequence opt4 from VP1__Norovirus_and/or_Norovirus-like__AB933746
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24886 - RNA, 1617 nt, Artificial Sequence
  derived and/or modified sequence opt4 from VP1__Norovirus_and/or_Norovirus-like__AB933701
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24887 - RNA, 1617 nt, Artificial Sequence
  derived and/or modified sequence opt4 from VP1__Norovirus_and/or_Norovirus-like__AB933686
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24888 - RNA, 1617 nt, Artificial Sequence
  derived and/or modified sequence opt4 from VP1__Norovirus_and/or_Norovirus-like__AB933680
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24889 - RNA, 1617 nt, Artificial Sequence
  derived and/or modified sequence opt4 from VP1__Norovirus_and/or_Norovirus-like__AB933672
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24890 - RNA, 1617 nt, Artificial Sequence
  derived and/or modified sequence opt4 from VP1__Norovirus_and/or_Norovirus-like__AB933664
augaagauggccagcaacgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucaacaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24891 - RNA, 1617 nt, Artificial Sequence
  derived and/or modified sequence opt4 from VP1__Norovirus_and/or_Norovirus-like__AB933662
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaucuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24892 - RNA, 1617 nt, Artificial Sequence
  derived and/or modified sequence opt4 from VP1__Norovirus_and/or_Norovirus-like__AB933656
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24893 - RNA, 1617 nt, Artificial Sequence
  derived and/or modified sequence opt4 from VP1__Norovirus_and/or_Norovirus-like__EU921340
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24894 - RNA, 1617 nt, Artificial Sequence
  derived and/or modified sequence opt4 from VP1__Norovirus_and/or_Norovirus-like__KC962453
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcauccccgugcugaccaucgaggagaugaccaacagcagauuccccaucccccuggagaagcuguucaccggccccagcagcgccuucguggugcagccccagaacggcagaugcagcaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccgugcugaccggcagcgccaacuucacccccaagcugggcagaauccaguucgccaccgacaccgacaacgacuucgagaccaaccagaacaccaaguucacccccgugggcgugauccaggacggcgacaccgcccacagaaacgagccccagcagugggugcugcccagcuacagcggcagaaacacccacaacgugcaccuggcccccgccguggcccccaccuuccccggcgagcagcugcuguucuucagaagcaccauccccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 24895 - RNA, 1617 nt, Artificial Sequence
  derived and/or modified sequence opt4 from VP1__Norovirus_and/or_Norovirus-like__KF712501
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcagcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24896 - RNA, 1617 nt, Artificial Sequence
  derived and/or modified sequence opt4 from VP1__Norovirus_and/or_Norovirus-like__JX459903
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgaccacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccaccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24897 - RNA, 1617 nt, Artificial Sequence
  derived and/or modified sequence opt4 from VP1__Norovirus_and/or_Norovirus-like__JX459629
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24898 - RNA, 1617 nt, Artificial Sequence
  derived and/or modified sequence opt4 from VP1__Norovirus_and/or_Norovirus-like__JX445165
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24899 - RNA, 1617 nt, Artificial Sequence
  derived and/or modified sequence opt4 from VP1__Norovirus_and/or_Norovirus-like__HM635156
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24900 - RNA, 1617 nt, Artificial Sequence
  derived and/or modified sequence opt4 from VP1__Norovirus_and/or_Norovirus-like__JQ622197
augaagauggccagcaacgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24901 - RNA, 1617 nt, Artificial Sequence
  derived and/or modified sequence opt4 from VP1__Norovirus_and/or_Norovirus-like__JQ613520
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugauccccagcaacggcuacuucagauucgacagcugggugaaccaguucuacacccuggcccccaugggcaacggcaccggcagaagaagauga

SEQ ID NO: 24902 - RNA, 1617 nt, Artificial Sequence
  derived and/or modified sequence opt4 from VP1__Norovirus_and/or_Norovirus-like__HQ456320
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24903 - RNA, 1617 nt, Artificial Sequence
  derived and/or modified sequence opt4 from VP1__Norovirus_and/or_Norovirus-like__AB541353
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24904 - RNA, 1617 nt, Artificial Sequence
  derived and/or modified sequence opt4 from VP1__Norovirus_and/or_Norovirus-like__AB541348
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24905 - RNA, 1617 nt, Artificial Sequence
  derived and/or modified sequence opt4 from VP1__Norovirus_and/or_Norovirus-like__AB541339
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24906 - RNA, 1617 nt, Artificial Sequence
  derived and/or modified sequence opt4 from VP1__Norovirus_and/or_Norovirus-like__AB541303
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccguguucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24907 - RNA, 1617 nt, Artificial Sequence
  derived and/or modified sequence opt4 from VP1__Norovirus_and/or_Norovirus-like__GQ246799
augaagauggccagcaacgacgccaaccccagcgacggcagcgccgccaaccuggugcccgagaucaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccccgccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24908 - RNA, 1617 nt, Artificial Sequence
  derived and/or modified sequence opt4 from VP1__Norovirus_and/or_Norovirus-like__EU876886
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagcagcgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24909 - RNA, 1617 nt, Artificial Sequence
  derived and/or modified sequence opt4 from VP1__Norovirus_and/or_Norovirus-like__AB385630
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24910 - RNA, 1617 nt, Artificial Sequence
  derived and/or modified sequence opt4 from VP1__Norovirus_and/or_Norovirus-like__KU182483
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24911 - RNA, 1617 nt, Artificial Sequence
  derived and/or modified sequence opt4 from VP1__Norovirus_and/or_Norovirus-like__AB665364
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24912 - RNA, 1617 nt, Artificial Sequence
  derived and/or modified sequence opt4 from VP1__Norovirus_and/or_Norovirus-like__AB663686
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugagcuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24913 - RNA, 1617 nt, Artificial Sequence
  derived and/or modified sequence opt4 from VP1__Norovirus_and/or_Norovirus-like__AB933702
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24914 - RNA, 1617 nt, Artificial Sequence
  derived and/or modified sequence opt4 from VP1__Norovirus_and/or_Norovirus-like__AB933685
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagauccaccagaacaccaaguucacccccgugggcgugauccaggacggcagcaccacccacagaaacgagccccagcagugggugcugcccagcuacagcggcagagacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24915 - RNA, 1617 nt, Artificial Sequence
  derived and/or modified sequence opt4 from VP1__Norovirus_and/or_Norovirus-like__AB933645
augaagauggccagcaacgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24916 - RNA, 1617 nt, Artificial Sequence
  derived and/or modified sequence opt4 from VP1__Norovirus_and/or_Norovirus-like__LC005706
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24917 - RNA, 1617 nt, Artificial Sequence
  derived and/or modified sequence opt4 from VP1__Norovirus_and/or_Norovirus-like__KM198562
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24918 - RNA, 1617 nt, Artificial Sequence
  derived and/or modified sequence opt4 from VP1__Norovirus_and/or_Norovirus-like__KC409311
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccaacaacgaccugggcgccaaccagaacaccaaguucacccccgugggcgugauccaggacggcggcaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24919 - RNA, 1617 nt, Artificial Sequence
  derived and/or modified sequence opt4 from VP1__Norovirus_and/or_Norovirus-like__KC409263
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24920 - RNA, 1617 nt, Artificial Sequence
  derived and/or modified sequence opt4 from VP1__Norovirus_and/or_Norovirus-like__JX459900
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24921 - RNA, 1617 nt, Artificial Sequence
  derived and/or modified sequence opt4 from VP1__Norovirus_and/or_Norovirus-like__JX459617
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24922 - RNA, 1617 nt, Artificial Sequence
  derived and/or modified sequence opt4 from VP1__Norovirus_and/or_Norovirus-like__GQ845366
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccaacuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugauccccagcaacggcuacuucagauucgacagcugggugaaccaguucuacacccuggcccccaugggcaacggcaccggcagaagaagauga

SEQ ID NO: 24923 - RNA, 1617 nt, Artificial Sequence
  derived and/or modified sequence opt4 from VP1__Norovirus_and/or_Norovirus-like__GQ845345
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgacaugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24924 - RNA, 1617 nt, Artificial Sequence
  derived and/or modified sequence opt4 from VP1__Norovirus_and/or_Norovirus-like__GQ845341
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccgagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24925 - RNA, 1617 nt, Artificial Sequence
  derived and/or modified sequence opt4 from VP1__Norovirus_and/or_Norovirus-like__HQ005292
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24926 - RNA, 1617 nt, Artificial Sequence
  derived and/or modified sequence opt4 from VP1__Norovirus_and/or_Norovirus-like__HQ456321
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccgugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24927 - RNA, 1617 nt, Artificial Sequence
  derived and/or modified sequence opt4 from VP1__Norovirus_and/or_Norovirus-like__AB541326
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24928 - RNA, 1617 nt, Artificial Sequence
  derived and/or modified sequence opt4 from VP1__Norovirus_and/or_Norovirus-like__AB541251
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggugagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 24929 - RNA, 1617 nt, Artificial Sequence
  derived and/or modified sequence opt4 from VP1__Norovirus_and/or_Norovirus-like__AB541241
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccaucgagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaggcgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24930 - RNA, 1617 nt, Artificial Sequence
  derived and/or modified sequence opt4 from VP1__Norovirus_and/or_Norovirus-like__AB541216
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24931 - RNA, 1617 nt, Artificial Sequence
  derived and/or modified sequence opt4 from VP1__Norovirus_and/or_Norovirus-like__EU876885
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgccaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24932 - RNA, 1617 nt, Artificial Sequence
  derived and/or modified sequence opt4 from VP1__Norovirus_and/or_Norovirus-like__AB447435
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24933 - RNA, 1617 nt, Artificial Sequence
  derived and/or modified sequence opt4 from VP1__Norovirus_and/or_Norovirus-like__KX354073
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24934 - RNA, 1617 nt, Artificial Sequence
  derived and/or modified sequence opt4 from VP1__Norovirus_and/or_Norovirus-like__KX353981
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24935 - RNA, 1617 nt, Artificial Sequence
  derived and/or modified sequence opt4 from VP1__Norovirus_and/or_Norovirus-like__KU182479
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcgcccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24936 - RNA, 1617 nt, Artificial Sequence
  derived and/or modified sequence opt4 from VP1__Norovirus_and/or_Norovirus-like__KU182478
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcuggaucaaccaguucuacacccuggcccccaugggcaacggcgccggcagaagaagauga

SEQ ID NO: 24937 - RNA, 1617 nt, Artificial Sequence
  derived and/or modified sequence opt4 from VP1__Norovirus_and/or_Norovirus-like__AB972501
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucggcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24938 - RNA, 1617 nt, Artificial Sequence
  derived and/or modified sequence opt4 from VP1__Norovirus_and/or_Norovirus-like__KR904214
augaagauggccagcagcgacgccaaccccagcgugggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcuggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgccaccgacaccgacaacgacuucgaggccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 24939 - RNA, 1617 nt, Artificial Sequence
  derived and/or modified sequence opt4 from VP1__Norovirus_and/or_Norovirus-like__AB933758
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24940 - RNA, 1617 nt, Artificial Sequence
  derived and/or modified sequence opt4 from VP1__Norovirus_and/or_Norovirus-like__AB933698
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucaagggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccaccagaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24941 - RNA, 1617 nt, Artificial Sequence
  derived and/or modified sequence opt4 from VP1__Norovirus_and/or_Norovirus-like__KJ678141
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccaacggcagcaccagaggccacaaggccaccguguacgccggcagcgccaacuucgcccccaagcugggcagagugcaguucgagaccgacaccgaccacgaccuggaggccaaccagaacaccaaguucacccccgugggcgugauccaggacggcaacaccacccacagaaacgagccccagcagugggugcugcccagcuacagcggcagaagcacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24942 - RNA, 1617 nt, Artificial Sequence
  derived and/or modified sequence opt4 from VP1__Norovirus_and/or_Norovirus-like__EU921347
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24943 - RNA, 1617 nt, Artificial Sequence
  derived and/or modified sequence opt4 from VP1__Norovirus_and/or_Norovirus-like__JX459628
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24944 - RNA, 1617 nt, Artificial Sequence
  derived and/or modified sequence opt4 from VP1__Norovirus_and/or_Norovirus-like__JQ613564
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccgccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgaguucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24945 - RNA, 1617 nt, Artificial Sequence
  derived and/or modified sequence opt4 from VP1__Norovirus_and/or_Norovirus-like__GQ845332
augaagauggccagcaacgacgccaaccccagcaacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24946 - RNA, 1617 nt, Artificial Sequence
  derived and/or modified sequence opt4 from VP1__Norovirus_and/or_Norovirus-like__GQ856461
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucaugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24947 - RNA, 1617 nt, Artificial Sequence
  derived and/or modified sequence opt4 from VP1__Norovirus_and/or_Norovirus-like__AB541245
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24948 - RNA, 1617 nt, Artificial Sequence
  derived and/or modified sequence opt4 from VP1__Norovirus_and/or_Norovirus-like__AB541229
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24949 - RNA, 1617 nt, Artificial Sequence
  derived and/or modified sequence opt4 from VP1__Norovirus_and/or_Norovirus-like__AB541226
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccugacccccaugggcaacggcaccggcagaagaagauga

SEQ ID NO: 24950 - RNA, 1617 nt, Artificial Sequence
  derived and/or modified sequence opt4 from VP1__Norovirus_and/or_Norovirus-like__DQ078814
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgaggugcugagccccagccaggugaccauguucccccacaucaucguggacgugagacagcuggagcccgugcugaucccccugcccgacgugagaaacaaccuguaccacuacaaccagagcaacgaccccaccaucagacugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcagaauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24951 - RNA, 1617 nt, Artificial Sequence
  derived and/or modified sequence opt4 from VP1__Norovirus_and/or_Norovirus-like__EU078416
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24952 - RNA, 1617 nt, Artificial Sequence
  derived and/or modified sequence opt4 from VP1__Norovirus_and/or_Norovirus-like__EU839590
augaagauggccagcaacgacgccaaccccagcggcggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24953 - RNA, 1617 nt, Artificial Sequence
  derived and/or modified sequence opt4 from VP1__Norovirus_and/or_Norovirus-like__AB294783
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24954 - RNA, 1617 nt, Artificial Sequence
  derived and/or modified sequence opt4 from VP1__Norovirus_and/or_Norovirus-like__AB303941
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24955 - RNA, 1617 nt, Artificial Sequence
  derived and/or modified sequence opt4 from VP1__Norovirus_and/or_Norovirus-like__EF126961
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgaggccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcgccggcagaagaagauga

SEQ ID NO: 24956 - RNA, 1617 nt, Artificial Sequence
  derived and/or modified sequence opt4 from VP1__Norovirus_and/or_Norovirus-like__LC153749
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24957 - RNA, 1617 nt, Artificial Sequence
  derived and/or modified sequence opt4 from VP1__Norovirus_and/or_Norovirus-like__KX371610
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagagcaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24958 - RNA, 1617 nt, Artificial Sequence
  derived and/or modified sequence opt4 from VP1__Norovirus_and/or_Norovirus-like__KX354031
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24959 - RNA, 1617 nt, Artificial Sequence
  derived and/or modified sequence opt4 from VP1__Norovirus_and/or_Norovirus-like__KX353990
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24960 - RNA, 1617 nt, Artificial Sequence
  derived and/or modified sequence opt4 from VP1__Norovirus_and/or_Norovirus-like__KX353972
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24961 - RNA, 1617 nt, Artificial Sequence
  derived and/or modified sequence opt4 from VP1__Norovirus_and/or_Norovirus-like__KX353968
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcggcaccacccacagaaacgagccccagcagugggugcugcccagcuacagcggcagaaacauccacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24962 - RNA, 1617 nt, Artificial Sequence
  derived and/or modified sequence opt4 from VP1__Norovirus_and/or_Norovirus-like__KX353967
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcggcaccacccacagaaacgagccccagcagugggugcugcccagcuacagcggcagaaacauccacaacgugcaccuggcccccgccguggcccccaacuuccccggcgagcagcugcuguucuucagaagcaccaugcccggcugcagcggcuaccccaacguggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24963 - RNA, 1617 nt, Artificial Sequence
  derived and/or modified sequence opt4 from VP1__Norovirus_and/or_Norovirus-like__KX353966
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccagaucaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugaaccacaucgccggcagcagaaacuacaccaugaaccuggccagccugaacuggaacaacuacgaccccaccgaggagacccccgccccccugggcacccccgacuucgugggcaagauccagggcgugcugacccagaccaccagaggcaacggcagcaccagaggccacagagccaccguguacaccggcagcgccgacuucacccccaagcugggcagaauccaguucgccaccgacaccgacaacgacuucgagacccaccagaacaccaaguucacccccgugggcgugauccaggacggcaacaccacccacagaaacgagccccagcagugggugcugcccagcuacagcggcagaaacgugcagaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuucgugaccguggcccacaccggccagcacgaccuggugaucccccccaacggcuacuucagauucgacagcugggugaaccaguucuacacccuggcccccaugggcaagggcaccggcagaagaagauga

SEQ ID NO: 24964 - RNA, 1617 nt, Artificial Sequence
  derived and/or modified sequence opt4 from VP1__Norovirus_and/or_Norovirus-like__AB663684
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24965 - RNA, 1617 nt, Artificial Sequence
  derived and/or modified sequence opt4 from VP1__Norovirus_and/or_Norovirus-like__KR904209
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccaacaacgacuucgacgccaaccagaacaccaaguucacccccgugggcgugauccaggacggcgagaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggagcuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24966 - RNA, 1617 nt, Artificial Sequence
  derived and/or modified sequence opt4 from VP1__Norovirus_and/or_Norovirus-like__AB933716
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24967 - RNA, 1617 nt, Artificial Sequence
  derived and/or modified sequence opt4 from VP1__Norovirus_and/or_Norovirus-like__AB933666
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccaggacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24968 - RNA, 1617 nt, Artificial Sequence
  derived and/or modified sequence opt4 from VP1__Norovirus_and/or_Norovirus-like__EU921349
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24969 - RNA, 1617 nt, Artificial Sequence
  derived and/or modified sequence opt4 from VP1__Norovirus_and/or_Norovirus-like__EU921348
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugaacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24970 - RNA, 1617 nt, Artificial Sequence
  derived and/or modified sequence opt4 from VP1__Norovirus_and/or_Norovirus-like__EU921345
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccgacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24971 - RNA, 1617 nt, Artificial Sequence
  derived and/or modified sequence opt4 from VP1__Norovirus_and/or_Norovirus-like__KP698924
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcauccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24972 - RNA, 1617 nt, Artificial Sequence
  derived and/or modified sequence opt4 from VP1__Norovirus_and/or_Norovirus-like__LC005707
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgaccagggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24973 - RNA, 1617 nt, Artificial Sequence
  derived and/or modified sequence opt4 from VP1__Norovirus_and/or_Norovirus-like__KJ541743
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24974 - RNA, 1617 nt, Artificial Sequence
  derived and/or modified sequence opt4 from VP1__Norovirus_and/or_Norovirus-like__KF177443
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24975 - RNA, 1617 nt, Artificial Sequence
  derived and/or modified sequence opt4 from VP1__Norovirus_and/or_Norovirus-like__JX439842
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaguguacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgcccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24976 - RNA, 1617 nt, Artificial Sequence
  derived and/or modified sequence opt4 from VP1__Norovirus_and/or_Norovirus-like__HF952135
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccgcccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24977 - RNA, 1617 nt, Artificial Sequence
  derived and/or modified sequence opt4 from VP1__Norovirus_and/or_Norovirus-like__JX459598
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggcacgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24978 - RNA, 1617 nt, Artificial Sequence
  derived and/or modified sequence opt4 from VP1__Norovirus_and/or_Norovirus-like__JX445162
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccugaucaucccccccaacggcuacuucagauucgacagcugggugaaccaguucuacacccuggcccccaugggcaacggcaccggcagaagaagauga

SEQ ID NO: 24979 - RNA, 1617 nt, Artificial Sequence
  derived and/or modified sequence opt4 from VP1__Norovirus_and/or_Norovirus-like__JX445154
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 24980 - RNA, 1617 nt, Artificial Sequence
  derived and/or modified sequence opt4 from VP1__Norovirus_and/or_Norovirus-like__JX155752
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacgccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuaccugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24981 - RNA, 1617 nt, Artificial Sequence
  derived and/or modified sequence opt4 from VP1__Norovirus_and/or_Norovirus-like__HM748971
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggcccugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24982 - RNA, 1617 nt, Artificial Sequence
  derived and/or modified sequence opt4 from VP1__Norovirus_and/or_Norovirus-like__GQ845367
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgacaugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24983 - RNA, 1617 nt, Artificial Sequence
  derived and/or modified sequence opt4 from VP1__Norovirus_and/or_Norovirus-like__GQ856455
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcacccacggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24984 - RNA, 1617 nt, Artificial Sequence
  derived and/or modified sequence opt4 from VP1__Norovirus_and/or_Norovirus-like__GQ856447
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccaaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24985 - RNA, 1617 nt, Artificial Sequence
  derived and/or modified sequence opt4 from VP1__Norovirus_and/or_Norovirus-like__AB541318
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24986 - RNA, 1617 nt, Artificial Sequence
  derived and/or modified sequence opt4 from VP1__Norovirus_and/or_Norovirus-like__AB541307
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugauccccagcaacggcuacuucagauucgacagcugggugaaccaguucuacacccuggcccccaugggcaacggcaccggcagaagaagauga

SEQ ID NO: 24987 - RNA, 1617 nt, Artificial Sequence
  derived and/or modified sequence opt4 from VP1__Norovirus_and/or_Norovirus-like__AB541254
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugaaggcccccggcggcgaguucaccgugagccccagaaacagccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24988 - RNA, 1617 nt, Artificial Sequence
  derived and/or modified sequence opt4 from VP1__Norovirus_and/or_Norovirus-like__AB541243
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24989 - RNA, 1617 nt, Artificial Sequence
  derived and/or modified sequence opt4 from VP1__Norovirus_and/or_Norovirus-like__AB541232
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24990 - RNA, 1617 nt, Artificial Sequence
  derived and/or modified sequence opt4 from VP1__Norovirus_and/or_Norovirus-like__GQ246800
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccccgugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24991 - RNA, 1617 nt, Artificial Sequence
  derived and/or modified sequence opt4 from VP1__Norovirus_and/or_Norovirus-like__GU390900
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24992 - RNA, 1617 nt, Artificial Sequence
  derived and/or modified sequence opt4 from VP1__Norovirus_and/or_Norovirus-like__AB504328
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccugaccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcaucaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24993 - RNA, 1617 nt, Artificial Sequence
  derived and/or modified sequence opt4 from VP1__Norovirus_and/or_Norovirus-like__AB447434
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24994 - RNA, 1617 nt, Artificial Sequence
  derived and/or modified sequence opt4 from VP1__Norovirus_and/or_Norovirus-like__EU839591
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagaucagaggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24995 - RNA, 1617 nt, Artificial Sequence
  derived and/or modified sequence opt4 from VP1__Norovirus_and/or_Norovirus-like__AB291542
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggccacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24996 - RNA, 1617 nt, Artificial Sequence
  derived and/or modified sequence opt4 from VP1__Norovirus_and/or_Norovirus-like__KX354123
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccacccuguacaccggcagcgccgaguucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccaccuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 24997 - RNA, 1617 nt, Artificial Sequence
  derived and/or modified sequence opt4 from VP1__Norovirus_and/or_Norovirus-like__KX354050
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggccuggaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24998 - RNA, 1617 nt, Artificial Sequence
  derived and/or modified sequence opt4 from VP1__Norovirus_and/or_Norovirus-like__AB933717
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 24999 - RNA, 1617 nt, Artificial Sequence
  derived and/or modified sequence opt4 from VP1__Norovirus_and/or_Norovirus-like__AB933707
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25000 - RNA, 1617 nt, Artificial Sequence
  derived and/or modified sequence opt4 from VP1__Norovirus_and/or_Norovirus-like__AB933705
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagacccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25001 - RNA, 1617 nt, Artificial Sequence
  derived and/or modified sequence opt4 from VP1__Norovirus_and/or_Norovirus-like__AB933704
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25002 - RNA, 1617 nt, Artificial Sequence
  derived and/or modified sequence opt4 from VP1__Norovirus_and/or_Norovirus-like__AB933699
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25003 - RNA, 1617 nt, Artificial Sequence
  derived and/or modified sequence opt4 from VP1__Norovirus_and/or_Norovirus-like__AB933679
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25004 - RNA, 1617 nt, Artificial Sequence
  derived and/or modified sequence opt4 from VP1__Norovirus_and/or_Norovirus-like__AB933661
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgagccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25005 - RNA, 1617 nt, Artificial Sequence
  derived and/or modified sequence opt4 from VP1__Norovirus_and/or_Norovirus-like__KT152148
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25006 - RNA, 1617 nt, Artificial Sequence
  derived and/or modified sequence opt4 from VP1__Norovirus_and/or_Norovirus-like__EU921393
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25007 - RNA, 1617 nt, Artificial Sequence
  derived and/or modified sequence opt4 from VP1__Norovirus_and/or_Norovirus-like__KM396961
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccgugagaaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25008 - RNA, 1617 nt, Artificial Sequence
  derived and/or modified sequence opt4 from VP1__Norovirus_and/or_Norovirus-like__KM198485
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25009 - RNA, 1617 nt, Artificial Sequence
  derived and/or modified sequence opt4 from VP1__Norovirus_and/or_Norovirus-like__KF306214
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaacggccagcacgaccuggugaucccccccaacggcuacuucagauucgacagcugggugaaccaguucuacacccuggcccccaugggcaacggcaccggcagaagaagauga

SEQ ID NO: 25010 - RNA, 1617 nt, Artificial Sequence
  derived and/or modified sequence opt4 from VP1__Norovirus_and/or_Norovirus-like__JX439831
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcaguuccuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25011 - RNA, 1617 nt, Artificial Sequence
  derived and/or modified sequence opt4 from VP1__Norovirus_and/or_Norovirus-like__KC409281
augaagauggccagcaacgacgccaaccccagcgacggcagcgccgccagccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25012 - RNA, 1617 nt, Artificial Sequence
  derived and/or modified sequence opt4 from VP1__Norovirus_and/or_Norovirus-like__JX459639
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25013 - RNA, 1617 nt, Artificial Sequence
  derived and/or modified sequence opt4 from VP1__Norovirus_and/or_Norovirus-like__JX459609
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucgccgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagauga

SEQ ID NO: 25014 - RNA, 1617 nt, Artificial Sequence
  derived and/or modified sequence opt4 from VP1__Norovirus_and/or_Norovirus-like__JN400599
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagcagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25015 - RNA, 1617 nt, Artificial Sequence
  derived and/or modified sequence opt4 from VP1__Norovirus_and/or_Norovirus-like__JQ613539
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25016 - RNA, 1617 nt, Artificial Sequence
  derived and/or modified sequence opt4 from VP1__Norovirus_and/or_Norovirus-like__HQ456329
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuaccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25017 - RNA, 1617 nt, Artificial Sequence
  derived and/or modified sequence opt4 from VP1__Norovirus_and/or_Norovirus-like__HM802536
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcgcccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25018 - RNA, 1617 nt, Artificial Sequence
  derived and/or modified sequence opt4 from VP1__Norovirus_and/or_Norovirus-like__HM802532
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25019 - RNA, 1617 nt, Artificial Sequence
  derived and/or modified sequence opt4 from VP1__Norovirus_and/or_Norovirus-like__AB541341
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25020 - RNA, 1617 nt, Artificial Sequence
  derived and/or modified sequence opt4 from VP1__Norovirus_and/or_Norovirus-like__AB541264
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25021 - RNA, 1617 nt, Artificial Sequence
  derived and/or modified sequence opt4 from VP1__Norovirus_and/or_Norovirus-like__AB541236
augaagauggccagcaacgacgccaaccccagcgacggcagcgccgccaaccuggugcaggaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaucaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25022 - RNA, 1617 nt, Artificial Sequence
  derived and/or modified sequence opt4 from VP1__Norovirus_and/or_Norovirus-like__AB541208
augaagauggccagcaacgaccccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25023 - RNA, 1617 nt, Artificial Sequence
  derived and/or modified sequence opt4 from VP1__Norovirus_and/or_Norovirus-like__EU876890
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaacuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25024 - RNA, 1617 nt, Artificial Sequence
  derived and/or modified sequence opt4 from VP1__Norovirus_and/or_Norovirus-like__AB385638
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccaacacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcggcgacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25025 - RNA, 1617 nt, Artificial Sequence
  derived and/or modified sequence opt4 from VP1__Norovirus_and/or_Norovirus-like__AB385635
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgacagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25026 - RNA, 1617 nt, Artificial Sequence
  derived and/or modified sequence opt4 from VP1__Norovirus_and/or_Norovirus-like__EU366113
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcagagcagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccgugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25027 - RNA, 1617 nt, Artificial Sequence
  derived and/or modified sequence opt4 from VP1__Norovirus_and/or_Norovirus-like__KX354097
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25028 - RNA, 1617 nt, Artificial Sequence
  derived and/or modified sequence opt4 from VP1__Norovirus_and/or_Norovirus-like__AB933727
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25029 - RNA, 1617 nt, Artificial Sequence
  derived and/or modified sequence opt4 from VP1__Norovirus_and/or_Norovirus-like__AB933726
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25030 - RNA, 1617 nt, Artificial Sequence
  derived and/or modified sequence opt4 from VP1__Norovirus_and/or_Norovirus-like__AB933720
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaaggugcagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25031 - RNA, 1617 nt, Artificial Sequence
  derived and/or modified sequence opt4 from VP1__Norovirus_and/or_Norovirus-like__AB933691
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25032 - RNA, 1617 nt, Artificial Sequence
  derived and/or modified sequence opt4 from VP1__Norovirus_and/or_Norovirus-like__AB933682
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25033 - RNA, 1617 nt, Artificial Sequence
  derived and/or modified sequence opt4 from VP1__Norovirus_and/or_Norovirus-like__KM245069
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25034 - RNA, 1617 nt, Artificial Sequence
  derived and/or modified sequence opt4 from VP1__Norovirus_and/or_Norovirus-like__LC005717
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25035 - RNA, 1617 nt, Artificial Sequence
  derived and/or modified sequence opt4 from VP1__Norovirus_and/or_Norovirus-like__LC005705
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25036 - RNA, 1617 nt, Artificial Sequence
  derived and/or modified sequence opt4 from VP1__Norovirus_and/or_Norovirus-like__KC894943
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccaacuacagcggcagcgacgugcccaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25037 - RNA, 1617 nt, Artificial Sequence
  derived and/or modified sequence opt4 from VP1__Norovirus_and/or_Norovirus-like__KF060023
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25038 - RNA, 1617 nt, Artificial Sequence
  derived and/or modified sequence opt4 from VP1__Norovirus_and/or_Norovirus-like__KC409310
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25039 - RNA, 1617 nt, Artificial Sequence
  derived and/or modified sequence opt4 from VP1__Norovirus_and/or_Norovirus-like__JX989073
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacauccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25040 - RNA, 1617 nt, Artificial Sequence
  derived and/or modified sequence opt4 from VP1__Norovirus_and/or_Norovirus-like__JX459902
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaucgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25041 - RNA, 1617 nt, Artificial Sequence
  derived and/or modified sequence opt4 from VP1__Norovirus_and/or_Norovirus-like__JX459644
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacaugaaccuggacugccugaucccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25042 - RNA, 1617 nt, Artificial Sequence
  derived and/or modified sequence opt4 from VP1__Norovirus_and/or_Norovirus-like__JX459610
augaagauggccagcaacgacgcccaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaccaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25043 - RNA, 1617 nt, Artificial Sequence
  derived and/or modified sequence opt4 from VP1__Norovirus_and/or_Norovirus-like__JX459606
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagagccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25044 - RNA, 1617 nt, Artificial Sequence
  derived and/or modified sequence opt4 from VP1__Norovirus_and/or_Norovirus-like__JX445159
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccgagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25045 - RNA, 1617 nt, Artificial Sequence
  derived and/or modified sequence opt4 from VP1__Norovirus_and/or_Norovirus-like__JN400606
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25046 - RNA, 1617 nt, Artificial Sequence
  derived and/or modified sequence opt4 from VP1__Norovirus_and/or_Norovirus-like__JQ613562
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagagcuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucggcaccgacaccgacaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaaagagauga

SEQ ID NO: 25047 - RNA, 1617 nt, Artificial Sequence
  derived and/or modified sequence opt4 from VP1__Norovirus_and/or_Norovirus-like__HQ456343
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggugccccccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25048 - RNA, 1617 nt, Artificial Sequence
  derived and/or modified sequence opt4 from VP1__Norovirus_and/or_Norovirus-like__HQ456342
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25049 - RNA, 1617 nt, Artificial Sequence
  derived and/or modified sequence opt4 from VP1__Norovirus_and/or_Norovirus-like__HQ456340
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagcagcagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaaggccgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25050 - RNA, 1617 nt, Artificial Sequence
  derived and/or modified sequence opt4 from VP1__Norovirus_and/or_Norovirus-like__HQ456326
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25051 - RNA, 1617 nt, Artificial Sequence
  derived and/or modified sequence opt4 from VP1__Norovirus_and/or_Norovirus-like__HM802527
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugacccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25052 - RNA, 1617 nt, Artificial Sequence
  derived and/or modified sequence opt4 from VP1__Norovirus_and/or_Norovirus-like__GQ856448
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25053 - RNA, 1617 nt, Artificial Sequence
  derived and/or modified sequence opt4 from VP1__Norovirus_and/or_Norovirus-like__AB541347
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgugcccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25054 - RNA, 1617 nt, Artificial Sequence
  derived and/or modified sequence opt4 from VP1__Norovirus_and/or_Norovirus-like__AB541298
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccugaccccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgaccuggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25055 - RNA, 1617 nt, Artificial Sequence
  derived and/or modified sequence opt4 from VP1__Norovirus_and/or_Norovirus-like__AB541270
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25056 - RNA, 1617 nt, Artificial Sequence
  derived and/or modified sequence opt4 from VP1__Norovirus_and/or_Norovirus-like__AB541263
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25057 - RNA, 1617 nt, Artificial Sequence
  derived and/or modified sequence opt4 from VP1__Norovirus_and/or_Norovirus-like__AB541256
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugaucccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25058 - RNA, 1617 nt, Artificial Sequence
  derived and/or modified sequence opt4 from VP1__Norovirus_and/or_Norovirus-like__AB541240
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccagcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagcaucaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccaccagaacgagccccagcagugggugcugcccggcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25059 - RNA, 1617 nt, Artificial Sequence
  derived and/or modified sequence opt4 from VP1__Norovirus_and/or_Norovirus-like__AB541233
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25060 - RNA, 1617 nt, Artificial Sequence
  derived and/or modified sequence opt4 from VP1__Norovirus_and/or_Norovirus-like__AB541215
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgagccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25061 - RNA, 1617 nt, Artificial Sequence
  derived and/or modified sequence opt4 from VP1__Norovirus_and/or_Norovirus-like__AB541201
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25062 - RNA, 1617 nt, Artificial Sequence
  derived and/or modified sequence opt4 from VP1__Norovirus_and/or_Norovirus-like__FJ411172
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggagcaacuacgaccccaccgaggagauccccgccccccugggcacccccgacuucgugggcaagauccagggcaugcugacccagaccaccagaagagacggcagcaccagaggccacaaggccaccgugcugaccggcagcgccgacuucgcccccaagcugggcagagugcaguucgccaccgacaccgacaacgacuucgagagcggcgagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25063 - RNA, 1617 nt, Artificial Sequence
  derived and/or modified sequence opt4 from VP1__Norovirus_and/or_Norovirus-like__AB447449
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccacuucuacacccuggcccccaugggcaacggcaccggcagaagaagauga

SEQ ID NO: 25064 - RNA, 1617 nt, Artificial Sequence
  derived and/or modified sequence opt4 from VP1__Norovirus_and/or_Norovirus-like__AB447431
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 25065 - RNA, 1617 nt, Artificial Sequence
  derived and/or modified sequence opt4 from VP1__Norovirus_and/or_Norovirus-like__EU078415
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagaaacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25066 - RNA, 1617 nt, Artificial Sequence
  derived and/or modified sequence opt4 from VP1__Norovirus_and/or_Norovirus-like__AB385643
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25067 - RNA, 1617 nt, Artificial Sequence
  derived and/or modified sequence opt4 from VP1__Norovirus_and/or_Norovirus-like__AB385636
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgacagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25068 - RNA, 1617 nt, Artificial Sequence
  derived and/or modified sequence opt4 from VP1__Norovirus_and/or_Norovirus-like__AB385629
augaagauggccagcaacgacgccacccccagcgacggcagcaccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccaacacccagaacuacaccaugaaccuggccagccagaacuggaacaacuacgaccccaccgaggagauccccgccccccugggcacccccgacuucgugggcagaauccagggcgugcugacccagaccaccagaggcgacggcagcaccagaggccacaaggccaccgugagcaccggcagcgugcacuucacccccaagcugggcagcgugcaguucagcaccgacaccagcaacgaccuggagaccggccagaacaccagauucacccccgugggcguggugcaggacggcggcaccacccacagaaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25069 - RNA, 1617 nt, Artificial Sequence
  derived and/or modified sequence opt4 from VP1__Norovirus_and/or_Norovirus-like__EU839586
augaagauggccagcaacgacgccagccccagcgacggcagcaccgccaaccuggugcccgaggugaacaacgaggugauggcccuggagcccguggugggcgccgccaucgccgcccccgugaccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25070 - RNA, 1617 nt, Artificial Sequence
  derived and/or modified sequence opt4 from VP1__Norovirus_and/or_Norovirus-like__EU310927
augaagauggccagcagcgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucaccaccgacaccaacaacgaccuggagaccggccagaacaccaaguucacccccgugggcguggugcaggacggcaacagcgcccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25071 - RNA, 1617 nt, Artificial Sequence
  derived and/or modified sequence opt4 from VP1__Norovirus_and/or_Norovirus-like__AB294787
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25072 - RNA, 1617 nt, Artificial Sequence
  derived and/or modified sequence opt4 from VP1__Norovirus_and/or_Norovirus-like__AY587987
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcgccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25073 - RNA, 1617 nt, Artificial Sequence
  derived and/or modified sequence opt4 from VP1__Norovirus_and/or_Norovirus-like__AY502019
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25074 - RNA, 1617 nt, Artificial Sequence
  derived and/or modified sequence opt4 from VP1__Norovirus_and/or_Norovirus-like__LC177653
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25075 - RNA, 1617 nt, Artificial Sequence
  derived and/or modified sequence opt4 from VP1__Norovirus_and/or_Norovirus-like__AB972486
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgccaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25076 - RNA, 1617 nt, Artificial Sequence
  derived and/or modified sequence opt4 from VP1__Norovirus_and/or_Norovirus-like__KR904235
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcaccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25077 - RNA, 1617 nt, Artificial Sequence
  derived and/or modified sequence opt4 from VP1__Norovirus_and/or_Norovirus-like__AB933753
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25078 - RNA, 1617 nt, Artificial Sequence
  derived and/or modified sequence opt4 from VP1__Norovirus_and/or_Norovirus-like__AB933721
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25079 - RNA, 1617 nt, Artificial Sequence
  derived and/or modified sequence opt4 from VP1__Norovirus_and/or_Norovirus-like__AB933706
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggccugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25080 - RNA, 1617 nt, Artificial Sequence
  derived and/or modified sequence opt4 from VP1__Norovirus_and/or_Norovirus-like__AB933669
augaagauggccagcaacgacgccaccgccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25081 - RNA, 1617 nt, Artificial Sequence
  derived and/or modified sequence opt4 from VP1__Norovirus_and/or_Norovirus-like__EU921350
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggcccugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25082 - RNA, 1617 nt, Artificial Sequence
  derived and/or modified sequence opt4 from VP1__Norovirus_and/or_Norovirus-like__LC005712
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25083 - RNA, 1617 nt, Artificial Sequence
  derived and/or modified sequence opt4 from VP1__Norovirus_and/or_Norovirus-like__LC018707
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucagccccaagcugggcagagugcaguucgagaccgacaccgaccacgacuucgaggugaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25084 - RNA, 1617 nt, Artificial Sequence
  derived and/or modified sequence opt4 from VP1__Norovirus_and/or_Norovirus-like__KM982955
augaagauggccagcagcgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25085 - RNA, 1617 nt, Artificial Sequence
  derived and/or modified sequence opt4 from VP1__Norovirus_and/or_Norovirus-like__KM982949
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucggcaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25086 - RNA, 1617 nt, Artificial Sequence
  derived and/or modified sequence opt4 from VP1__Norovirus_and/or_Norovirus-like__KM406485
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25087 - RNA, 1617 nt, Artificial Sequence
  derived and/or modified sequence opt4 from VP1__Norovirus_and/or_Norovirus-like__KM198574
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25088 - RNA, 1617 nt, Artificial Sequence
  derived and/or modified sequence opt4 from VP1__Norovirus_and/or_Norovirus-like__KM198517
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaucaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacauccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25089 - RNA, 1617 nt, Artificial Sequence
  derived and/or modified sequence opt4 from VP1__Norovirus_and/or_Norovirus-like__JX439839
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25090 - RNA, 1617 nt, Artificial Sequence
  derived and/or modified sequence opt4 from VP1__Norovirus_and/or_Norovirus-like__JX439837
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25091 - RNA, 1617 nt, Artificial Sequence
  derived and/or modified sequence opt4 from VP1__Norovirus_and/or_Norovirus-like__KC631815
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25092 - RNA, 1617 nt, Artificial Sequence
  derived and/or modified sequence opt4 from VP1__Norovirus_and/or_Norovirus-like__KC409315
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgaggacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25093 - RNA, 1617 nt, Artificial Sequence
  derived and/or modified sequence opt4 from VP1__Norovirus_and/or_Norovirus-like__KC409289
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggaggugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25094 - RNA, 1617 nt, Artificial Sequence
  derived and/or modified sequence opt4 from VP1__Norovirus_and/or_Norovirus-like__KC409278
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25095 - RNA, 1617 nt, Artificial Sequence
  derived and/or modified sequence opt4 from VP1__Norovirus_and/or_Norovirus-like__KC175402
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25096 - RNA, 1617 nt, Artificial Sequence
  derived and/or modified sequence opt4 from VP1__Norovirus_and/or_Norovirus-like__JX459616
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25097 - RNA, 1617 nt, Artificial Sequence
  derived and/or modified sequence opt4 from VP1__Norovirus_and/or_Norovirus-like__JX459599
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugaccaacaucgccggcagccagaccuacaccaugaaccuggccagccagaacuggaacaacuacgaccccaccgaggagauccccgccccccugggcacccccgacuucgugggcagaauccagggcgugcugacccagaccaccagaggcgacggcagcaccagaggccacaaggccaccgugagcaccggcagcgccuacuucacccccaagcugggcagcgugcaguucagcaccgacaccagcaccgacuucgagaccggccagaacaccagauucacccccgugggcguggugcaggacggcagcaccacccacaagaacgagccccagcagugggugcugcccagcuacagcggcagagacagccacaacgugcaccuggcccccgccguggcccccaccuuccccggcgagcagauccuguucuucagaagcaccaugcccggcugcagcggcuaccccaacauggaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25098 - RNA, 1617 nt, Artificial Sequence
  derived and/or modified sequence opt4 from VP1__Norovirus_and/or_Norovirus-like__JN400603
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaucaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25099 - RNA, 1617 nt, Artificial Sequence
  derived and/or modified sequence opt4 from VP1__Norovirus_and/or_Norovirus-like__JQ613572
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagacccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccacccagggcgacggcagcaccagaggccacaaggccaccguguacaccggcagcgccgacuucacccccaagcugggcagcgugcaguucgccaccgacaccgagaacgacuucgagacccaccagaacaccaaguucacccccgugggcgugauccaggacggcagcaccacccacagaaacgagccccagcagugggcccugcccagcuacagcggcagaagcgcccacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25100 - RNA, 1617 nt, Artificial Sequence
  derived and/or modified sequence opt4 from VP1__Norovirus_and/or_Norovirus-like__JQ613525
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25101 - RNA, 1617 nt, Artificial Sequence
  derived and/or modified sequence opt4 from VP1__Norovirus_and/or_Norovirus-like__JQ613510
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacgccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25102 - RNA, 1617 nt, Artificial Sequence
  derived and/or modified sequence opt4 from VP1__Norovirus_and/or_Norovirus-like__GQ856450
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccagcaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25103 - RNA, 1617 nt, Artificial Sequence
  derived and/or modified sequence opt4 from VP1__Norovirus_and/or_Norovirus-like__AB541296
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugauccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25104 - RNA, 1617 nt, Artificial Sequence
  derived and/or modified sequence opt4 from VP1__Norovirus_and/or_Norovirus-like__AB541212
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25105 - RNA, 1617 nt, Artificial Sequence
  derived and/or modified sequence opt4 from VP1__Norovirus_and/or_Norovirus-like__AB504321
augaagauggccagcaacgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25106 - RNA, 1617 nt, Artificial Sequence
  derived and/or modified sequence opt4 from VP1__Norovirus_and/or_Norovirus-like__AB294785
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25107 - RNA, 1617 nt, Artificial Sequence
  derived and/or modified sequence opt4 from VP1__Norovirus_and/or_Norovirus-like__AB294780
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccaagggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25108 - RNA, 1617 nt, Artificial Sequence
  derived and/or modified sequence opt4 from VP1__Norovirus_and/or_Norovirus-like__AB303933
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuaccugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25109 - RNA, 1617 nt, Artificial Sequence
  derived and/or modified sequence opt4 from VP1__Norovirus_and/or_Norovirus-like__AY587988
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcgccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25110 - RNA, 1617 nt, Artificial Sequence
  derived and/or modified sequence opt4 from VP1__Norovirus_and/or_Norovirus-like__KX354103
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgaguucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25111 - RNA, 1617 nt, Artificial Sequence
  derived and/or modified sequence opt4 from VP1__Norovirus_and/or_Norovirus-like__KX354048
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacaccgaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25112 - RNA, 1617 nt, Artificial Sequence
  derived and/or modified sequence opt4 from VP1__Norovirus_and/or_Norovirus-like__KX354047
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25113 - RNA, 1617 nt, Artificial Sequence
  derived and/or modified sequence opt4 from VP1__Norovirus_and/or_Norovirus-like__KU985161
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgccaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25114 - RNA, 1617 nt, Artificial Sequence
  derived and/or modified sequence opt4 from VP1__Norovirus_and/or_Norovirus-like__AB972517
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25115 - RNA, 1617 nt, Artificial Sequence
  derived and/or modified sequence opt4 from VP1__Norovirus_and/or_Norovirus-like__AB972494
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25116 - RNA, 1617 nt, Artificial Sequence
  derived and/or modified sequence opt4 from VP1__Norovirus_and/or_Norovirus-like__KU311163
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccagaucgccagcacccagaccuacaccaugaaccuggccagccugaacuggaacaacuacgaccccaccgaggagauccccgccccccugggcgcccccgacuucaugggcaagauccagggcgugcugacccagaccaccagacaggacggcagcaccagaggccacaaggccaccgugagcaccggcagcgugcacuucacccccaagcugggcagcgugagauucgacaccgacaccaacaacaaccugcagccccaccagagcaccagauucacccccgugggcgugauccaggacggcgacacccaccagaacgagccccagcagugggugcugcccugcuacagcggcagagacgugaacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacaaccuggugaucccccccaacggcuacuucagauucgacagcugggugaaccaguucuacacccuggcccccaugggcaacggcaccggcagaagaagaguguga

SEQ ID NO: 25117 - RNA, 1617 nt, Artificial Sequence
  derived and/or modified sequence opt4 from VP1__Norovirus_and/or_Norovirus-like__KR904236
augaagauggccagcagcgacgccaacagcagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgccaccgacaccgacaacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 25118 - RNA, 1617 nt, Artificial Sequence
  derived and/or modified sequence opt4 from VP1__Norovirus_and/or_Norovirus-like__KR904225
augaagauggccagcagcgacgccaaccccagcgagggcagcaccgccagccuggugcccgaggugaacaacgaggugauggcccuggagcccguggccggcgccgccaucgccgcccccguggccggccaggugaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgagcccaccaucaagcugguggccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucagcggcagcagaaaccacaccaugaaccuggccagccagaacuggaacagcuacgaccccaccgaggagauccccgccccccugggcacccccgacuucgugggcaagauccagggcgugcugacccagaccaccagaagcgacggcagcaccagaggccacaaggccaccguguacaccggcagcgccgacuucagccccaagcugggcagaauccaguucgccaccgacaccgacaacgacuucgagaccaaccagaacaccaaguucacccccgugggcgugauccaggacggcggcaccacccacagaaacgagccccagcagugggugcugcccaccuacagcggcagaaacacccacaacgugcaccuggcccccgccguggcccccaccuuccccggcgagcagcugcuguucuucagaagcaccaugcccggcugcagcggcuaccccgacauggaccuggacugccugcugccccaggagugggugcagcacuucuaccaggaggccgcccccgcccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuucacccuggcccccaugggcaacggcaccggcagaagaagauga

SEQ ID NO: 25119 - RNA, 1617 nt, Artificial Sequence
  derived and/or modified sequence opt4 from VP1__Norovirus_and/or_Norovirus-like__LC005710
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccacccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25120 - RNA, 1617 nt, Artificial Sequence
  derived and/or modified sequence opt4 from VP1__Norovirus_and/or_Norovirus-like__LC018709
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccggcgagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucggcaccgacaccgaccacgaccuggaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25121 - RNA, 1617 nt, Artificial Sequence
  derived and/or modified sequence opt4 from VP1__Norovirus_and/or_Norovirus-like__KM198587
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25122 - RNA, 1617 nt, Artificial Sequence
  derived and/or modified sequence opt4 from VP1__Norovirus_and/or_Norovirus-like__KM198560
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25123 - RNA, 1617 nt, Artificial Sequence
  derived and/or modified sequence opt4 from VP1__Norovirus_and/or_Norovirus-like__KM198521
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcgccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25124 - RNA, 1617 nt, Artificial Sequence
  derived and/or modified sequence opt4 from VP1__Norovirus_and/or_Norovirus-like__KM198490
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacaucacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagagagacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25125 - RNA, 1617 nt, Artificial Sequence
  derived and/or modified sequence opt4 from VP1__Norovirus_and/or_Norovirus-like__KC409241
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25126 - RNA, 1617 nt, Artificial Sequence
  derived and/or modified sequence opt4 from VP1__Norovirus_and/or_Norovirus-like__JX459625
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25127 - RNA, 1617 nt, Artificial Sequence
  derived and/or modified sequence opt4 from VP1__Norovirus_and/or_Norovirus-like__JX459613
augaagauggccagcaacgacgcccaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25128 - RNA, 1617 nt, Artificial Sequence
  derived and/or modified sequence opt4 from VP1__Norovirus_and/or_Norovirus-like__JX459600
augaagauggccagcaacgacgccaaccccagcgacggcagcgccgcccaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25129 - RNA, 1617 nt, Artificial Sequence
  derived and/or modified sequence opt4 from VP1__Norovirus_and/or_Norovirus-like__JX459596
augaagauggccagcaacgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25130 - RNA, 1617 nt, Artificial Sequence
  derived and/or modified sequence opt4 from VP1__Norovirus_and/or_Norovirus-like__JX155749
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25131 - RNA, 1617 nt, Artificial Sequence
  derived and/or modified sequence opt4 from VP1__Norovirus_and/or_Norovirus-like__JQ613511
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25132 - RNA, 1617 nt, Artificial Sequence
  derived and/or modified sequence opt4 from VP1__Norovirus_and/or_Norovirus-like__HM802547
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25133 - RNA, 1617 nt, Artificial Sequence
  derived and/or modified sequence opt4 from VP1__Norovirus_and/or_Norovirus-like__HM802544
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25134 - RNA, 1617 nt, Artificial Sequence
  derived and/or modified sequence opt4 from VP1__Norovirus_and/or_Norovirus-like__GQ856456
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucgugggcgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucaagggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25135 - RNA, 1617 nt, Artificial Sequence
  derived and/or modified sequence opt4 from VP1__Norovirus_and/or_Norovirus-like__AB541332
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgcccaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25136 - RNA, 1617 nt, Artificial Sequence
  derived and/or modified sequence opt4 from VP1__Norovirus_and/or_Norovirus-like__AB541316
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccauggaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25137 - RNA, 1617 nt, Artificial Sequence
  derived and/or modified sequence opt4 from VP1__Norovirus_and/or_Norovirus-like__AB541238
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25138 - RNA, 1617 nt, Artificial Sequence
  derived and/or modified sequence opt4 from VP1__Norovirus_and/or_Norovirus-like__AB535750
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugaccagaaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25139 - RNA, 1617 nt, Artificial Sequence
  derived and/or modified sequence opt4 from VP1__Norovirus_and/or_Norovirus-like__FJ538900
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccgccgaggagauccccgccccccugggcacccccgacuucgugggcagaauccagggcgugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25140 - RNA, 1617 nt, Artificial Sequence
  derived and/or modified sequence opt4 from VP1__Norovirus_and/or_Norovirus-like__EU876889
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25141 - RNA, 1617 nt, Artificial Sequence
  derived and/or modified sequence opt4 from VP1__Norovirus_and/or_Norovirus-like__EU876887
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccagcuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25142 - RNA, 1617 nt, Artificial Sequence
  derived and/or modified sequence opt4 from VP1__Norovirus_and/or_Norovirus-like__FJ411171
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggagcaacuacgaccccaccgaggagauccccgccccccugggcacccccgacuucgugggcaagauccagggcaugcugacccagaccaccagaagagacggcagcaccagaggccacaaggccaccgugcugaccggcagcgccgacuucgcccccaagcugggcagagugcaguucgccaccgacaccgacaacgacuucgagagcggcgagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25143 - RNA, 1617 nt, Artificial Sequence
  derived and/or modified sequence opt4 from VP1__Norovirus_and/or_Norovirus-like__AB447460
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacagcuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25144 - RNA, 1617 nt, Artificial Sequence
  derived and/or modified sequence opt4 from VP1__Norovirus_and/or_Norovirus-like__AB447454
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25145 - RNA, 1617 nt, Artificial Sequence
  derived and/or modified sequence opt4 from VP1__Norovirus_and/or_Norovirus-like__AB447443
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagcugcccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25146 - RNA, 1617 nt, Artificial Sequence
  derived and/or modified sequence opt4 from VP1__Norovirus_and/or_Norovirus-like__AB447430
augaagauggccagcaacgacgccaaccccagcgacggcagcaccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccaaggugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25147 - RNA, 1617 nt, Artificial Sequence
  derived and/or modified sequence opt4 from VP1__Norovirus_and/or_Norovirus-like__EU078420
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuuccaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25148 - RNA, 1617 nt, Artificial Sequence
  derived and/or modified sequence opt4 from VP1__Norovirus_and/or_Norovirus-like__AB385637
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25149 - RNA, 1617 nt, Artificial Sequence
  derived and/or modified sequence opt4 from VP1__Norovirus_and/or_Norovirus-like__EF202568
augaagauggccagcaacgacgccacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccaccccccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25150 - RNA, 1617 nt, Artificial Sequence
  derived and/or modified sequence opt4 from VP1__Norovirus_and/or_Norovirus-like__AB294781
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccaagggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25151 - RNA, 1617 nt, Artificial Sequence
  derived and/or modified sequence opt4 from VP1__Norovirus_and/or_Norovirus-like__AB303940
augaagauggccagcaacgacgccacccccagcgacggcagcaccgccaaccuggugcccgaggugaacaccgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagaaccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25152 - RNA, 1617 nt, Artificial Sequence
  derived and/or modified sequence opt4 from VP1__Norovirus_and/or_Norovirus-like__DQ415279
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacgugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25153 - RNA, 1617 nt, Artificial Sequence
  derived and/or modified sequence opt4 from VP1__Norovirus_and/or_Norovirus-like__DQ078794
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgaggugcugagccccagccaggugaccauguucccccacaucaucguggacgugagacagcuggagcccgugcugaucccccugcccgacgugagaaacaaccuguaccacuacaaccagagcaacgaccccaccaucagacugaucgccaugcuguacaccccccugagagccaacaacgccggcgacgacguguucaccgugagcugcagagugcugaccagacccagccccgacuucgacuucauguuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcgcccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcuggaucaaccaguucuacacccuggcccccaugggcaacggcgccggcagaagaagauga

SEQ ID NO: 25154 - RNA, 1617 nt, Artificial Sequence
  derived and/or modified sequence opt4 from VP1__Norovirus_and/or_Norovirus-like__KP784691
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcgacgcccacuucacccccaagcugggcagcgugauguucagcaccgacaccaacaacgacuucgagaccggccagaacaccagauucacccccgugggcguggugcaggacggcagcaccacccaccagaacgagccccagcagugggugcugcccagcuaccugggcagagacagccacaacgugcaccuggcccccgccguggcccccagcuuccccggcgagcagcugcuguucuucagaagcaccaugcccggcugcagcggcuaccccaacaugaacauggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25155 - RNA, 1617 nt, Artificial Sequence
  derived and/or modified sequence opt4 from VP1__Norovirus_and/or_Norovirus-like__KX907727
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaucguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25156 - RNA, 1617 nt, Artificial Sequence
  derived and/or modified sequence opt4 from VP1__Norovirus_and/or_Norovirus-like__KX354049
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25157 - RNA, 1617 nt, Artificial Sequence
  derived and/or modified sequence opt4 from VP1__Norovirus_and/or_Norovirus-like__KX354024
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25158 - RNA, 1617 nt, Artificial Sequence
  derived and/or modified sequence opt4 from VP1__Norovirus_and/or_Norovirus-like__KX353955
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25159 - RNA, 1617 nt, Artificial Sequence
  derived and/or modified sequence opt4 from VP1__Norovirus_and/or_Norovirus-like__AB972518
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaccacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25160 - RNA, 1617 nt, Artificial Sequence
  derived and/or modified sequence opt4 from VP1__Norovirus_and/or_Norovirus-like__AB933744
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagauga

SEQ ID NO: 25161 - RNA, 1617 nt, Artificial Sequence
  derived and/or modified sequence opt4 from VP1__Norovirus_and/or_Norovirus-like__AB933673
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggccagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25162 - RNA, 1617 nt, Artificial Sequence
  derived and/or modified sequence opt4 from VP1__Norovirus_and/or_Norovirus-like__KM245070
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25163 - RNA, 1617 nt, Artificial Sequence
  derived and/or modified sequence opt4 from VP1__Norovirus_and/or_Norovirus-like__EU921382
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25164 - RNA, 1617 nt, Artificial Sequence
  derived and/or modified sequence opt4 from VP1__Norovirus_and/or_Norovirus-like__KP293589
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggacauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25165 - RNA, 1617 nt, Artificial Sequence
  derived and/or modified sequence opt4 from VP1__Norovirus_and/or_Norovirus-like__KP241908
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25166 - RNA, 1617 nt, Artificial Sequence
  derived and/or modified sequence opt4 from VP1__Norovirus_and/or_Norovirus-like__KJ451059
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25167 - RNA, 1617 nt, Artificial Sequence
  derived and/or modified sequence opt4 from VP1__Norovirus_and/or_Norovirus-like__KM198570
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggggcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaacggccagcacgaccuggugaucccccccaacggcuacuucagauucgacagcugggugaaccaguucuacacccuggcccccaugggcaacggcaccggcagaagaagauga

SEQ ID NO: 25168 - RNA, 1617 nt, Artificial Sequence
  derived and/or modified sequence opt4 from VP1__Norovirus_and/or_Norovirus-like__KM198558
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgcccccuucgcccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25169 - RNA, 1617 nt, Artificial Sequence
  derived and/or modified sequence opt4 from VP1__Norovirus_and/or_Norovirus-like__AB447456
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25170 - RNA, 1617 nt, Artificial Sequence
  derived and/or modified sequence opt4 from VP1__Norovirus_and/or_Norovirus-like__KF177444
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugaucgacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25171 - RNA, 1617 nt, Artificial Sequence
  derived and/or modified sequence opt4 from VP1__Norovirus_and/or_Norovirus-like__KF429776
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25172 - RNA, 1617 nt, Artificial Sequence
  derived and/or modified sequence opt4 from VP1__Norovirus_and/or_Norovirus-like__KC243078
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgagguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25173 - RNA, 1617 nt, Artificial Sequence
  derived and/or modified sequence opt4 from VP1__Norovirus_and/or_Norovirus-like__KC409280
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaaggaggacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagauccuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25174 - RNA, 1617 nt, Artificial Sequence
  derived and/or modified sequence opt4 from VP1__Norovirus_and/or_Norovirus-like__KC175357
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25175 - RNA, 1617 nt, Artificial Sequence
  derived and/or modified sequence opt4 from VP1__Norovirus_and/or_Norovirus-like__JX459621
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacguggcccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccgacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25176 - RNA, 1617 nt, Artificial Sequence
  derived and/or modified sequence opt4 from VP1__Norovirus_and/or_Norovirus-like__JQ613541
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccguggugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaucggccagcacgaccuggugaucccccccaacggcuacuucagauucgacagcugggugaaccaguucuacacccuggcccccaugggcaacggcaccggcagaagaagauga

SEQ ID NO: 25177 - RNA, 1617 nt, Artificial Sequence
  derived and/or modified sequence opt4 from VP1__Norovirus_and/or_Norovirus-like__JQ613527
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccugggugagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcaccgaguucagccccaagcugggcagagugcaguucgccaccgacaccaacaacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25178 - RNA, 1617 nt, Artificial Sequence
  derived and/or modified sequence opt4 from VP1__Norovirus_and/or_Norovirus-like__JF827296
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacguguucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggccccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcauccaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25179 - RNA, 1617 nt, Artificial Sequence
  derived and/or modified sequence opt4 from VP1__Norovirus_and/or_Norovirus-like__JF713050
augaagauggccagcaacgacgccaaccccagcgacggcagcgccgccaaccuggugcccgaggugaacaacgaggugauggcccuggagcccguggccggcgccgcccuggccgcccccguggccggccagcagaacgugaucgaccccuggaucagaaacaacuucgugcaggcccccggcggcgaguucaccgugagccccagaaacgcccccggcgagauccuguggagcgccccccugagccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgagcccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcagcuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagcaucaacuggaacaacuacgaccccaccgaggagauccccgccccccugggcacccccgacuucgugggcaagauccagggcaugcugacccagaccaccagaggcgacggcagcaccagaggccacagagccaccguguacaccggcagcgcccccuucacccccaagcugggcagcgugcaguucaccaccgacaccgacaacgacuucgagaccaaccagaacaccaaguucacccccgugggcguggugcaggacggcgacaccgcccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25180 - RNA, 1617 nt, Artificial Sequence
  derived and/or modified sequence opt4 from VP1__Norovirus_and/or_Norovirus-like__HM802548
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaagcuacagaaugaaccuggccagccagaacuggaacaacuacgaccccaccgaggagauccccgccccccugggcacccccgacuucgugggcaagauccagggcaugcugacccagaccaccaagagagacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25181 - RNA, 1617 nt, Artificial Sequence
  derived and/or modified sequence opt4 from VP1__Norovirus_and/or_Norovirus-like__GQ856459
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacggccuggugaucccccccaacggcuacuucagauucgacagcugggugaaccaguucuacacccuggcccccaugggcaacggcaccggcagaagaagauga

SEQ ID NO: 25182 - RNA, 1617 nt, Artificial Sequence
  derived and/or modified sequence opt4 from VP1__Norovirus_and/or_Norovirus-like__AB541308
augaagauggccagcaacgacgccaaccccagcgacggcagcgccgccaaccuggugcccgaggugaacaacgaggugauggcccuggaccccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucugccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25183 - RNA, 1617 nt, Artificial Sequence
  derived and/or modified sequence opt4 from VP1__Norovirus_and/or_Norovirus-like__AB541276
augaagauggccagcaacgacgccaaccccagcgacggcagcgccgccagccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25184 - RNA, 1617 nt, Artificial Sequence
  derived and/or modified sequence opt4 from VP1__Norovirus_and/or_Norovirus-like__AB541224
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25185 - RNA, 1617 nt, Artificial Sequence
  derived and/or modified sequence opt4 from VP1__Norovirus_and/or_Norovirus-like__AB504330
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccugaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25186 - RNA, 1617 nt, Artificial Sequence
  derived and/or modified sequence opt4 from VP1__Norovirus_and/or_Norovirus-like__AB447445
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgacggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25187 - RNA, 1617 nt, Artificial Sequence
  derived and/or modified sequence opt4 from VP1__Norovirus_and/or_Norovirus-like__AB294793
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25188 - RNA, 1617 nt, Artificial Sequence
  derived and/or modified sequence opt4 from VP1__Norovirus_and/or_Norovirus-like__AB303934
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcgugauccaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25189 - RNA, 1617 nt, Artificial Sequence
  derived and/or modified sequence opt4 from VP1__Norovirus_and/or_Norovirus-like__KU678205
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaaggugcagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25190 - RNA, 1617 nt, Artificial Sequence
  derived and/or modified sequence opt4 from VP1__Norovirus_and/or_Norovirus-like__LC177657
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccuggugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25191 - RNA, 1617 nt, Artificial Sequence
  derived and/or modified sequence opt4 from VP1__Norovirus_and/or_Norovirus-like__LC177656
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagaaucgacggcagcaccagaggccacaaggccaccguguacaccggcagcgccgacuucgcccccaagcugggcagagugcaguucgagaccgacaccgaccacgacuucgaggccaaccagagcaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25192 - RNA, 1617 nt, Artificial Sequence
  derived and/or modified sequence opt4 from VP1__Norovirus_and/or_Norovirus-like__KX354136
augaagauggccagcagcgacgccaaccccagcgacggcagcgccgccaaccuggugcccgaggugagcaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaagcgacggcagcaccagaggccacaaggccaccguguacaccggcagcgccgacuucgcccccaagcugggcagagugcaguucgagaccgacaccgacagagacuucgagaccaaccagaacaccaaguucacccccgugggcgugauccaggacggcaccaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25193 - RNA, 1617 nt, Artificial Sequence
  derived and/or modified sequence opt4 from VP1__Norovirus_and/or_Norovirus-like__KX354121
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacaucacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgaguucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25194 - RNA, 1617 nt, Artificial Sequence
  derived and/or modified sequence opt4 from VP1__Norovirus_and/or_Norovirus-like__KX354110
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagcaccgacggcagcaccagaggccacaaggccaccguguacaccggcagcgccgaguucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25195 - RNA, 1617 nt, Artificial Sequence
  derived and/or modified sequence opt4 from VP1__Norovirus_and/or_Norovirus-like__KX354107
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25196 - RNA, 1617 nt, Artificial Sequence
  derived and/or modified sequence opt4 from VP1__Norovirus_and/or_Norovirus-like__KX353991
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagaauccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25197 - RNA, 1617 nt, Artificial Sequence
  derived and/or modified sequence opt4 from VP1__Norovirus_and/or_Norovirus-like__KU985162
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25198 - RNA, 1617 nt, Artificial Sequence
  derived and/or modified sequence opt4 from VP1__Norovirus_and/or_Norovirus-like__AB972476
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25199 - RNA, 1617 nt, Artificial Sequence
  derived and/or modified sequence opt4 from VP1__Norovirus_and/or_Norovirus-like__KU311162
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccagaucgccagcacccagaccuacaccaugaaccuggccagccugaacuggaacaacuacgaccccaccgaggagauccccgccccccugggcgcccccgacuucaugggcaagauccagggcgugcugacccagaccaccagacagggcggcagcaccagaggccacaaggccaccgugagcaccggcagcgugcacuucacccccaagcugggcagcgugagauucgacaccgacaccaacaacgaccugcagccccaccagagcaccagauucacccccgugggcgugauccaggacggcgacacccaccagaacgagccccagcagugggcccugcccugcuacagcggcagagacgugaacaacgugcaccuggcccccgccguggcccccagcuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacaaccuggugaucccccccaacggcuacuucagauucgacagcugggugaaccaguucuacacccuggcccccaugggcaacggcaccggcagaagaagaguguga

SEQ ID NO: 25200 - RNA, 1617 nt, Artificial Sequence
  derived and/or modified sequence opt4 from VP1__Norovirus_and/or_Norovirus-like__KR904212
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaccuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguucaccggcagcgccgacuucagccccaagcugggcagagugcaguucgccaccgacaccgacaacgacuucguggccaaccagaacaccaaguucacccccgugggcgugauccaggacggcggcaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25201 - RNA, 1617 nt, Artificial Sequence
  derived and/or modified sequence opt4 from VP1__Norovirus_and/or_Norovirus-like__AB933678
augaagauggccagcaacgacgccaaccccuucgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccgccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25202 - RNA, 1617 nt, Artificial Sequence
  derived and/or modified sequence opt4 from VP1__Norovirus_and/or_Norovirus-like__AB933648
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25203 - RNA, 1617 nt, Artificial Sequence
  derived and/or modified sequence opt4 from VP1__Norovirus_and/or_Norovirus-like__LN854571
augaagauggccagcaacgacgccgcccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25204 - RNA, 1617 nt, Artificial Sequence
  derived and/or modified sequence opt4 from VP1__Norovirus_and/or_Norovirus-like__EU921384
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25205 - RNA, 1617 nt, Artificial Sequence
  derived and/or modified sequence opt4 from VP1__Norovirus_and/or_Norovirus-like__LC005716
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcggcaacuacaccaugaaccuggccagcgugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25206 - RNA, 1617 nt, Artificial Sequence
  derived and/or modified sequence opt4 from VP1__Norovirus_and/or_Norovirus-like__KP241914
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacgcccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25207 - RNA, 1617 nt, Artificial Sequence
  derived and/or modified sequence opt4 from VP1__Norovirus_and/or_Norovirus-like__KJ433968
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcccggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaagcgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25208 - RNA, 1617 nt, Artificial Sequence
  derived and/or modified sequence opt4 from VP1__Norovirus_and/or_Norovirus-like__KP176409
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25209 - RNA, 1617 nt, Artificial Sequence
  derived and/or modified sequence opt4 from VP1__Norovirus_and/or_Norovirus-like__KM514064
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25210 - RNA, 1617 nt, Artificial Sequence
  derived and/or modified sequence opt4 from VP1__Norovirus_and/or_Norovirus-like__KJ649703
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagaauccaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25211 - RNA, 1617 nt, Artificial Sequence
  derived and/or modified sequence opt4 from VP1__Norovirus_and/or_Norovirus-like__KF177447
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaucaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25212 - RNA, 1617 nt, Artificial Sequence
  derived and/or modified sequence opt4 from VP1__Norovirus_and/or_Norovirus-like__JX439820
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcagcagcagaaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgacaccgacaccgacaacgacuucgagaccaaccagaacaccaaguucacccccgugggcgugauccaggacggcagcaccaccuacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25213 - RNA, 1617 nt, Artificial Sequence
  derived and/or modified sequence opt4 from VP1__Norovirus_and/or_Norovirus-like__HF952120
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcuggugccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgaggccaaccagaacaccaaguucacccccgugggcgugauccaggacggcagcaccgcccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25214 - RNA, 1617 nt, Artificial Sequence
  derived and/or modified sequence opt4 from VP1__Norovirus_and/or_Norovirus-like__KC517369
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccaccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25215 - RNA, 1617 nt, Artificial Sequence
  derived and/or modified sequence opt4 from VP1__Norovirus_and/or_Norovirus-like__KC409293
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25216 - RNA, 1617 nt, Artificial Sequence
  derived and/or modified sequence opt4 from VP1__Norovirus_and/or_Norovirus-like__JX984951
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcggcaccacccacagaaacgagccccagcagugggugcugcccaacuacagcggcagcgacgugcccaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25217 - RNA, 1617 nt, Artificial Sequence
  derived and/or modified sequence opt4 from VP1__Norovirus_and/or_Norovirus-like__JX459612
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagcagagacggcagcaccagaggccacaaggccaccgugagcaccggcagcgugcacuucacccccaagcugggcagagugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25218 - RNA, 1617 nt, Artificial Sequence
  derived and/or modified sequence opt4 from VP1__Norovirus_and/or_Norovirus-like__JX459604
augaagauggccagcaacgacgugacccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25219 - RNA, 1617 nt, Artificial Sequence
  derived and/or modified sequence opt4 from VP1__Norovirus_and/or_Norovirus-like__JX155745
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgcccccuucacccccaagaugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25220 - RNA, 1617 nt, Artificial Sequence
  derived and/or modified sequence opt4 from VP1__Norovirus_and/or_Norovirus-like__HM635155
augaagauggccagcagcgacaccaagaccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaucgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25221 - RNA, 1617 nt, Artificial Sequence
  derived and/or modified sequence opt4 from VP1__Norovirus_and/or_Norovirus-like__JN400620
augaagauggccagcaacgacgugaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25222 - RNA, 1617 nt, Artificial Sequence
  derived and/or modified sequence opt4 from VP1__Norovirus_and/or_Norovirus-like__JQ613573
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccagcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25223 - RNA, 1617 nt, Artificial Sequence
  derived and/or modified sequence opt4 from VP1__Norovirus_and/or_Norovirus-like__JQ478408
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25224 - RNA, 1617 nt, Artificial Sequence
  derived and/or modified sequence opt4 from VP1__Norovirus_and/or_Norovirus-like__EF684915
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaaguggaacaaguacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucagcaccgacaccgagaacgacuucgagacccaccagaacaccaaguucacccccgugggcgugacccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25225 - RNA, 1617 nt, Artificial Sequence
  derived and/or modified sequence opt4 from VP1__Norovirus_and/or_Norovirus-like__HQ456331
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25226 - RNA, 1617 nt, Artificial Sequence
  derived and/or modified sequence opt4 from VP1__Norovirus_and/or_Norovirus-like__HQ456322
augaagaucgccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25227 - RNA, 1617 nt, Artificial Sequence
  derived and/or modified sequence opt4 from VP1__Norovirus_and/or_Norovirus-like__HM802551
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25228 - RNA, 1617 nt, Artificial Sequence
  derived and/or modified sequence opt4 from VP1__Norovirus_and/or_Norovirus-like__HM802546
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25229 - RNA, 1617 nt, Artificial Sequence
  derived and/or modified sequence opt4 from VP1__Norovirus_and/or_Norovirus-like__GQ856453
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagccugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25230 - RNA, 1617 nt, Artificial Sequence
  derived and/or modified sequence opt4 from VP1__Norovirus_and/or_Norovirus-like__GQ856445
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagagcggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacguggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25231 - RNA, 1617 nt, Artificial Sequence
  derived and/or modified sequence opt4 from VP1__Norovirus_and/or_Norovirus-like__AB541358
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcugauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 25232 - RNA, 1617 nt, Artificial Sequence
  derived and/or modified sequence opt4 from VP1__Norovirus_and/or_Norovirus-like__AB541349
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccauccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25233 - RNA, 1617 nt, Artificial Sequence
  derived and/or modified sequence opt4 from VP1__Norovirus_and/or_Norovirus-like__AB541342
augaagauggccagcaacgacgccaaccccagcgacggcagcgccgccaaccuggugcccgaggugaacaacgaggugauggcccuggagcccguggugggcgccgccaucgccgcccccguggccggccagaccaacgugaucgaccccuggaucagaaacaacuucgugcaggcccccggcggcgaguucaccgugagccccagaaacgcccccggcgagauccuguggagcgcccccagcggccccgaccugaaccccuaccugagccaccuggccagaauguucaacgacuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcagcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25234 - RNA, 1617 nt, Artificial Sequence
  derived and/or modified sequence opt4 from VP1__Norovirus_and/or_Norovirus-like__AB541248
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25235 - RNA, 1617 nt, Artificial Sequence
  derived and/or modified sequence opt4 from VP1__Norovirus_and/or_Norovirus-like__GQ246798
augaagauggccagcagcgacgccaaccccuucgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25236 - RNA, 1617 nt, Artificial Sequence
  derived and/or modified sequence opt4 from VP1__Norovirus_and/or_Norovirus-like__GQ246791
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguuccccagaaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggaacaacuacgaccccaccgaggagauccccgccccccugggcacccccgacuucgugggcaagauccagggcaugcugacccagaccaccagaagcgacggcagcaccagaggccacaaggccaccgugcugaccggcagcgccgacuucgcccccaagcugggcagagugcaguucgccaccgacaccgacaacgacuucgagagcggccagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugaucccccaggacugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25237 - RNA, 1617 nt, Artificial Sequence
  derived and/or modified sequence opt4 from VP1__Norovirus_and/or_Norovirus-like__GU350225
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25238 - RNA, 1617 nt, Artificial Sequence
  derived and/or modified sequence opt4 from VP1__Norovirus_and/or_Norovirus-like__AB504319
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggaggugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25239 - RNA, 1617 nt, Artificial Sequence
  derived and/or modified sequence opt4 from VP1__Norovirus_and/or_Norovirus-like__AB447458
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25240 - RNA, 1617 nt, Artificial Sequence
  derived and/or modified sequence opt4 from VP1__Norovirus_and/or_Norovirus-like__AB385640
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacagcuacgccggcggcuucgaggugcaggugauccuggccggcaacgccuucaccgccggcaagaucaucuucgccgccgugccccccaacuuccccaucgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccacccccguggagaagcuguucaccggccccagcagcgccuucaucgugcagccccagaacggcagaugcaccaucgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccagacagaacaccagauucacccccgugggcgugauccaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugauguucgagugcaagcugcacaagagcggcuacaucaccguggcccacaccggccagcacgaccuggugaucccccccaacggcuacuucagauucgacgccugggugaaccaguucuacacccuggcccccaugggcaacggcaccggcagaagaagauga

SEQ ID NO: 25241 - RNA, 1617 nt, Artificial Sequence
  derived and/or modified sequence opt4 from VP1__Norovirus_and/or_Norovirus-like__AB385633
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuaccugggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25242 - RNA, 1617 nt, Artificial Sequence
  derived and/or modified sequence opt4 from VP1__Norovirus_and/or_Norovirus-like__DQ658413
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccgacacccacaacuacaccaugaaccuggccagccagaacuggaacaacuacgaccccaccgaggagauccccgccccccugggcacccccgacuucgugggcaagauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25243 - RNA, 1617 nt, Artificial Sequence
  derived and/or modified sequence opt4 from VP1__Norovirus_and/or_Norovirus-like__AB220923
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25244 - RNA, 1617 nt, Artificial Sequence
  derived and/or modified sequence opt4 from VP1__Norovirus_and/or_Norovirus-like__AY588016
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcgccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25245 - RNA, 1617 nt, Artificial Sequence
  derived and/or modified sequence opt4 from VP1__Norovirus_and/or_Norovirus-like__AY502022
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25246 - RNA, 1617 nt, Artificial Sequence
  derived and/or modified sequence opt4 from VP1__Norovirus_and/or_Norovirus-like__KX158280
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25247 - RNA, 1617 nt, Artificial Sequence
  derived and/or modified sequence opt4 from VP1__Norovirus_and/or_Norovirus-like__KX371606
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25248 - RNA, 1617 nt, Artificial Sequence
  derived and/or modified sequence opt4 from VP1__Norovirus_and/or_Norovirus-like__KX371605
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagagcaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25249 - RNA, 1617 nt, Artificial Sequence
  derived and/or modified sequence opt4 from VP1__Norovirus_and/or_Norovirus-like__KX354128
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25250 - RNA, 1617 nt, Artificial Sequence
  derived and/or modified sequence opt4 from VP1__Norovirus_and/or_Norovirus-like__KX354099
augaagauggccagcagcgacgccagccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25251 - RNA, 1617 nt, Artificial Sequence
  derived and/or modified sequence opt4 from VP1__Norovirus_and/or_Norovirus-like__KX354087
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcuguucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagauccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25252 - RNA, 1617 nt, Artificial Sequence
  derived and/or modified sequence opt4 from VP1__Norovirus_and/or_Norovirus-like__KX354009
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25253 - RNA, 1617 nt, Artificial Sequence
  derived and/or modified sequence opt4 from VP1__Norovirus_and/or_Norovirus-like__KR131784
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaacauggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25254 - RNA, 1617 nt, Artificial Sequence
  derived and/or modified sequence opt4 from VP1__Norovirus_and/or_Norovirus-like__AB972527
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagauacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25255 - RNA, 1617 nt, Artificial Sequence
  derived and/or modified sequence opt4 from VP1__Norovirus_and/or_Norovirus-like__AB972525
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccgugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25256 - RNA, 1617 nt, Artificial Sequence
  derived and/or modified sequence opt4 from VP1__Norovirus_and/or_Norovirus-like__KT780388
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgccaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25257 - RNA, 1617 nt, Artificial Sequence
  derived and/or modified sequence opt4 from VP1__Norovirus_and/or_Norovirus-like__KT780373
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgccaccgacaccgaccacgacuucguggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25258 - RNA, 1617 nt, Artificial Sequence
  derived and/or modified sequence opt4 from VP1__Norovirus_and/or_Norovirus-like__AB933723
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccagcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccgccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25259 - RNA, 1617 nt, Artificial Sequence
  derived and/or modified sequence opt4 from VP1__Norovirus_and/or_Norovirus-like__AB933708
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25260 - RNA, 1617 nt, Artificial Sequence
  derived and/or modified sequence opt4 from VP1__Norovirus_and/or_Norovirus-like__LC066046
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25261 - RNA, 1617 nt, Artificial Sequence
  derived and/or modified sequence opt4 from VP1__Norovirus_and/or_Norovirus-like__KJ678140
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacguggugaucgacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25262 - RNA, 1617 nt, Artificial Sequence
  derived and/or modified sequence opt4 from VP1__Norovirus_and/or_Norovirus-like__KJ678139
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25263 - RNA, 1617 nt, Artificial Sequence
  derived and/or modified sequence opt4 from VP1__Norovirus_and/or_Norovirus-like__EU921383
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25264 - RNA, 1617 nt, Artificial Sequence
  derived and/or modified sequence opt4 from VP1__Norovirus_and/or_Norovirus-like__KP176405
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25265 - RNA, 1617 nt, Artificial Sequence
  derived and/or modified sequence opt4 from VP1__Norovirus_and/or_Norovirus-like__KP176403
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccagauucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25266 - RNA, 1617 nt, Artificial Sequence
  derived and/or modified sequence opt4 from VP1__Norovirus_and/or_Norovirus-like__KP096343
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25267 - RNA, 1617 nt, Artificial Sequence
  derived and/or modified sequence opt4 from VP1__Norovirus_and/or_Norovirus-like__KM268101
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagaauccaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25268 - RNA, 1617 nt, Artificial Sequence
  derived and/or modified sequence opt4 from VP1__Norovirus_and/or_Norovirus-like__KM198568
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcggcgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25269 - RNA, 1617 nt, Artificial Sequence
  derived and/or modified sequence opt4 from VP1__Norovirus_and/or_Norovirus-like__KM198532
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccgugccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25270 - RNA, 1617 nt, Artificial Sequence
  derived and/or modified sequence opt4 from VP1__Norovirus_and/or_Norovirus-like__KM198527
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25271 - RNA, 1617 nt, Artificial Sequence
  derived and/or modified sequence opt4 from VP1__Norovirus_and/or_Norovirus-like__KF177448
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25272 - RNA, 1617 nt, Artificial Sequence
  derived and/or modified sequence opt4 from VP1__Norovirus_and/or_Norovirus-like__KF008244
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25273 - RNA, 1617 nt, Artificial Sequence
  derived and/or modified sequence opt4 from VP1__Norovirus_and/or_Norovirus-like__KF060103
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25274 - RNA, 1617 nt, Artificial Sequence
  derived and/or modified sequence opt4 from VP1__Norovirus_and/or_Norovirus-like__KC960615
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25275 - RNA, 1617 nt, Artificial Sequence
  derived and/or modified sequence opt4 from VP1__Norovirus_and/or_Norovirus-like__KC517373
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcggcuuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaaggugcagggcgugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccgcccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagagagaccuggugaucccccccaacggcuacuucagauucgacagcugggugaaccaguucuacacccuggcccccaugggcaacggcaccggcagaagaagauga

SEQ ID NO: 25276 - RNA, 1617 nt, Artificial Sequence
  derived and/or modified sequence opt4 from VP1__Norovirus_and/or_Norovirus-like__JX459615
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgaguucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25277 - RNA, 1617 nt, Artificial Sequence
  derived and/or modified sequence opt4 from VP1__Norovirus_and/or_Norovirus-like__JX459603
augaagauggccagcaacgacgccacccccagcgacggcguggccgcccaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25278 - RNA, 1617 nt, Artificial Sequence
  derived and/or modified sequence opt4 from VP1__Norovirus_and/or_Norovirus-like__JX155746
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25279 - RNA, 1617 nt, Artificial Sequence
  derived and/or modified sequence opt4 from VP1__Norovirus_and/or_Norovirus-like__AB541333
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccuggaccccgaccugaaccccuaccugagccagcuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25280 - RNA, 1617 nt, Artificial Sequence
  derived and/or modified sequence opt4 from VP1__Norovirus_and/or_Norovirus-like__AB541220
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcuguacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25281 - RNA, 1617 nt, Artificial Sequence
  derived and/or modified sequence opt4 from VP1__Norovirus_and/or_Norovirus-like__AB504312
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcgagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25282 - RNA, 1617 nt, Artificial Sequence
  derived and/or modified sequence opt4 from VP1__Norovirus_and/or_Norovirus-like__GQ849126
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25283 - RNA, 1617 nt, Artificial Sequence
  derived and/or modified sequence opt4 from VP1__Norovirus_and/or_Norovirus-like__AB447459
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugaucuucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25284 - RNA, 1617 nt, Artificial Sequence
  derived and/or modified sequence opt4 from VP1__Norovirus_and/or_Norovirus-like__EU078413
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccagaacuggaacaacuacgaccccaccgaggagauccccgccccccugggcacccccgacuucgugggcagaauccagggcaugcugacccagaccaccagaagagacggcagcaccagaggccacaaggccaccgugagcaccggcgacgcccacuucacccccaagcugggcagcaucauguucagcaccgacaccgacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25285 - RNA, 1617 nt, Artificial Sequence
  derived and/or modified sequence opt4 from VP1__Norovirus_and/or_Norovirus-like__EU078411
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25286 - RNA, 1617 nt, Artificial Sequence
  derived and/or modified sequence opt4 from VP1__Norovirus_and/or_Norovirus-like__AB385632
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggaggugcccgccccccugggcacccccgacuucaugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugagccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25287 - RNA, 1617 nt, Artificial Sequence
  derived and/or modified sequence opt4 from VP1__Norovirus_and/or_Norovirus-like__EU839595
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccggcuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25288 - RNA, 1617 nt, Artificial Sequence
  derived and/or modified sequence opt4 from VP1__Norovirus_and/or_Norovirus-like__AB294788
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccaccagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccgacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25289 - RNA, 1617 nt, Artificial Sequence
  derived and/or modified sequence opt4 from VP1__Norovirus_and/or_Norovirus-like__AB303936
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcgugcaguucgacaccgacaccaacagcgacuucgagaccggccagaacaccaaguucacccccgugggcguggugcaggacggcaacggcgcccaccagaacgagccccagcagugggugcugcccagcuacagcggcagaaccggccacaacgcccaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25290 - RNA, 1617 nt, Artificial Sequence
  derived and/or modified sequence opt4 from VP1__Norovirus_and/or_Norovirus-like__AB303935
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25291 - RNA, 1617 nt, Artificial Sequence
  derived and/or modified sequence opt4 from VP1__Norovirus_and/or_Norovirus-like__AY588018
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcgugcaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25292 - RNA, 1617 nt, Artificial Sequence
  derived and/or modified sequence opt4 from VP1__Norovirus_and/or_Norovirus-like__KU678203
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25293 - RNA, 1617 nt, Artificial Sequence
  derived and/or modified sequence opt4 from VP1__Norovirus_and/or_Norovirus-like__KP176410
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacaccgaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25294 - RNA, 1617 nt, Artificial Sequence
  derived and/or modified sequence opt4 from VP1__Norovirus_and/or_Norovirus-like__KX371609
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccagaggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25295 - RNA, 1617 nt, Artificial Sequence
  derived and/or modified sequence opt4 from VP1__Norovirus_and/or_Norovirus-like__KX354130
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacaucacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgaguucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaaagagauga

SEQ ID NO: 25296 - RNA, 1617 nt, Artificial Sequence
  derived and/or modified sequence opt4 from VP1__Norovirus_and/or_Norovirus-like__KX354120
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggugaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25297 - RNA, 1617 nt, Artificial Sequence
  derived and/or modified sequence opt4 from VP1__Norovirus_and/or_Norovirus-like__KX354113
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25298 - RNA, 1617 nt, Artificial Sequence
  derived and/or modified sequence opt4 from VP1__Norovirus_and/or_Norovirus-like__KX354105
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25299 - RNA, 1617 nt, Artificial Sequence
  derived and/or modified sequence opt4 from VP1__Norovirus_and/or_Norovirus-like__KX354077
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccagaggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaagcgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25300 - RNA, 1617 nt, Artificial Sequence
  derived and/or modified sequence opt4 from VP1__Norovirus_and/or_Norovirus-like__KR131785
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25301 - RNA, 1617 nt, Artificial Sequence
  derived and/or modified sequence opt4 from VP1__Norovirus_and/or_Norovirus-like__AB972530
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25302 - RNA, 1617 nt, Artificial Sequence
  derived and/or modified sequence opt4 from VP1__Norovirus_and/or_Norovirus-like__AB972526
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25303 - RNA, 1617 nt, Artificial Sequence
  derived and/or modified sequence opt4 from VP1__Norovirus_and/or_Norovirus-like__AB972522
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagaauccaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25304 - RNA, 1617 nt, Artificial Sequence
  derived and/or modified sequence opt4 from VP1__Norovirus_and/or_Norovirus-like__AB972514
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaucaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25305 - RNA, 1617 nt, Artificial Sequence
  derived and/or modified sequence opt4 from VP1__Norovirus_and/or_Norovirus-like__AB972505
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccgcccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25306 - RNA, 1617 nt, Artificial Sequence
  derived and/or modified sequence opt4 from VP1__Norovirus_and/or_Norovirus-like__AB972473
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25307 - RNA, 1617 nt, Artificial Sequence
  derived and/or modified sequence opt4 from VP1__Norovirus_and/or_Norovirus-like__KT780381
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggacauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25308 - RNA, 1617 nt, Artificial Sequence
  derived and/or modified sequence opt4 from VP1__Norovirus_and/or_Norovirus-like__KT780372
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25309 - RNA, 1617 nt, Artificial Sequence
  derived and/or modified sequence opt4 from VP1__Norovirus_and/or_Norovirus-like__KT202797
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaagcacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25310 - RNA, 1617 nt, Artificial Sequence
  derived and/or modified sequence opt4 from VP1__Norovirus_and/or_Norovirus-like__KR904226
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaagcgcccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25311 - RNA, 1617 nt, Artificial Sequence
  derived and/or modified sequence opt4 from VP1__Norovirus_and/or_Norovirus-like__KR904208
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcaacaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccacuucuacacccuggcccccgugggcaacggcaccggcagaagaagauga

SEQ ID NO: 25312 - RNA, 1617 nt, Artificial Sequence
  derived and/or modified sequence opt4 from VP1__Norovirus_and/or_Norovirus-like__AB933709
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccacgacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25313 - RNA, 1617 nt, Artificial Sequence
  derived and/or modified sequence opt4 from VP1__Norovirus_and/or_Norovirus-like__EU921352
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccgacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25314 - RNA, 1617 nt, Artificial Sequence
  derived and/or modified sequence opt4 from VP1__Norovirus_and/or_Norovirus-like__LC005735
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25315 - RNA, 1617 nt, Artificial Sequence
  derived and/or modified sequence opt4 from VP1__Norovirus_and/or_Norovirus-like__KP241909
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacaccgaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25316 - RNA, 1617 nt, Artificial Sequence
  derived and/or modified sequence opt4 from VP1__Norovirus_and/or_Norovirus-like__KJ533132
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25317 - RNA, 1617 nt, Artificial Sequence
  derived and/or modified sequence opt4 from VP1__Norovirus_and/or_Norovirus-like__KP176407
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacagagaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25318 - RNA, 1617 nt, Artificial Sequence
  derived and/or modified sequence opt4 from VP1__Norovirus_and/or_Norovirus-like__KP176406
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcauccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25319 - RNA, 1617 nt, Artificial Sequence
  derived and/or modified sequence opt4 from VP1__Norovirus_and/or_Norovirus-like__KP123606
augaagauggccagcagcgacgccaaccccagcgacggcagcgccgccaaccuggugcccgaggugaacaacgaggugauggcccuggagcccguggugggcgccaccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcauccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25320 - RNA, 1617 nt, Artificial Sequence
  derived and/or modified sequence opt4 from VP1__Norovirus_and/or_Norovirus-like__KP096335
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccugaccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25321 - RNA, 1617 nt, Artificial Sequence
  derived and/or modified sequence opt4 from VP1__Norovirus_and/or_Norovirus-like__KM268095
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25322 - RNA, 1617 nt, Artificial Sequence
  derived and/or modified sequence opt4 from VP1__Norovirus_and/or_Norovirus-like__KM268094
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25323 - RNA, 1617 nt, Artificial Sequence
  derived and/or modified sequence opt4 from VP1__Norovirus_and/or_Norovirus-like__KM268093
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25324 - RNA, 1617 nt, Artificial Sequence
  derived and/or modified sequence opt4 from VP1__Norovirus_and/or_Norovirus-like__KM198591
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25325 - RNA, 1617 nt, Artificial Sequence
  derived and/or modified sequence opt4 from VP1__Norovirus_and/or_Norovirus-like__KM198589
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagauccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacagaagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25326 - RNA, 1617 nt, Artificial Sequence
  derived and/or modified sequence opt4 from VP1__Norovirus_and/or_Norovirus-like__KM198576
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25327 - RNA, 1617 nt, Artificial Sequence
  derived and/or modified sequence opt4 from VP1__Norovirus_and/or_Norovirus-like__KM198564
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucaucgugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25328 - RNA, 1617 nt, Artificial Sequence
  derived and/or modified sequence opt4 from VP1__Norovirus_and/or_Norovirus-like__KJ716355
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25329 - RNA, 1617 nt, Artificial Sequence
  derived and/or modified sequence opt4 from VP1__Norovirus_and/or_Norovirus-like__KJ685408
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccaccagaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25330 - RNA, 1617 nt, Artificial Sequence
  derived and/or modified sequence opt4 from VP1__Norovirus_and/or_Norovirus-like__KJ144999
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccaacuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25331 - RNA, 1617 nt, Artificial Sequence
  derived and/or modified sequence opt4 from VP1__Norovirus_and/or_Norovirus-like__KF060016
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25332 - RNA, 1617 nt, Artificial Sequence
  derived and/or modified sequence opt4 from VP1__Norovirus_and/or_Norovirus-like__KC517367
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgccagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccgcccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25333 - RNA, 1617 nt, Artificial Sequence
  derived and/or modified sequence opt4 from VP1__Norovirus_and/or_Norovirus-like__KC517366
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaacagcgccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25334 - RNA, 1617 nt, Artificial Sequence
  derived and/or modified sequence opt4 from VP1__Norovirus_and/or_Norovirus-like__KC517359
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagaagacuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccuacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaucaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccugaucaucccccccaacggcuacuucagauucgacagcugggugaaccaguucuacacccuggcccccaugggcaacggcaccggcagaagaagauga

SEQ ID NO: 25335 - RNA, 1617 nt, Artificial Sequence
  derived and/or modified sequence opt4 from VP1__Norovirus_and/or_Norovirus-like__KC409303
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25336 - RNA, 1617 nt, Artificial Sequence
  derived and/or modified sequence opt4 from VP1__Norovirus_and/or_Norovirus-like__JX459608
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25337 - RNA, 1617 nt, Artificial Sequence
  derived and/or modified sequence opt4 from VP1__Norovirus_and/or_Norovirus-like__JQ320073
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25338 - RNA, 1617 nt, Artificial Sequence
  derived and/or modified sequence opt4 from VP1__Norovirus_and/or_Norovirus-like__HM802552
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25339 - RNA, 1617 nt, Artificial Sequence
  derived and/or modified sequence opt4 from VP1__Norovirus_and/or_Norovirus-like__AB541320
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggccagcagaaccaagcccuucagcgugcccagcgugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccaccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25340 - RNA, 1617 nt, Artificial Sequence
  derived and/or modified sequence opt4 from VP1__Norovirus_and/or_Norovirus-like__AB541227
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25341 - RNA, 1617 nt, Artificial Sequence
  derived and/or modified sequence opt4 from VP1__Norovirus_and/or_Norovirus-like__AB504318
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggccugcugacccagaccaccaagggcgacggcagcaccagaggccacaaggccaccguguacaccggcagcgcccccuucacccccaagcugggcggcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25342 - RNA, 1617 nt, Artificial Sequence
  derived and/or modified sequence opt4 from VP1__Norovirus_and/or_Norovirus-like__AB504311
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaaccuacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25343 - RNA, 1617 nt, Artificial Sequence
  derived and/or modified sequence opt4 from VP1__Norovirus_and/or_Norovirus-like__FJ537135
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugagccccgaccugaaccccuaccugagccaccugagcagaauguacaacggcuacgccggcggcuucgaggugcaggugauccuggccggcaacgccuucaccgccggcaagaucaucuucgccgccaucccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugagccacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcagcggcagaaagagaguguga

SEQ ID NO: 25344 - RNA, 1617 nt, Artificial Sequence
  derived and/or modified sequence opt4 from VP1__Norovirus_and/or_Norovirus-like__GQ413969
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagagacuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagaaacuacaccaugaaccuggccagccagaacuggagcaacuacgaccccaccgaggagauccccgccccccugggcacccccgacuucgugggcaagauccagggcaugcugacccagaccaccggcagagacggcagcaccagaggccacaaggccaccgugcugaccggcagcgccgacuucgcccccaagcugggcagagugcaguucgccaccgacaccgacaacgacuucgagagcggcgagaacaccaaguucacccccgugggcgugauccaggacggcagcaccacccacagaaacgagccccagcagugggugcugcccaacuacagcggcagaaccggccacaacgugcaccuggcccccgccguggcccccaccuaccccggcgagcagcugcuguucuucagaagcaccaugcccggcugcagcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25345 - RNA, 1617 nt, Artificial Sequence
  derived and/or modified sequence opt4 from VP1__Norovirus_and/or_Norovirus-like__EU839592
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccgccuacaccggcagcgcccccuucacccccaagcugggcagcgugcaguucagcaccgacaccgagaacgacuucgagacccaccagaacaccaaguucgcccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25346 - RNA, 1617 nt, Artificial Sequence
  derived and/or modified sequence opt4 from VP1__Norovirus_and/or_Norovirus-like__EU839587
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagagccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25347 - RNA, 1617 nt, Artificial Sequence
  derived and/or modified sequence opt4 from VP1__Norovirus_and/or_Norovirus-like__EU839583
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25348 - RNA, 1617 nt, Artificial Sequence
  derived and/or modified sequence opt4 from VP1__Norovirus_and/or_Norovirus-like__AB303931
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25349 - RNA, 1617 nt, Artificial Sequence
  derived and/or modified sequence opt4 from VP1__Norovirus_and/or_Norovirus-like__KY341923
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcuuccccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25350 - RNA, 1617 nt, Artificial Sequence
  derived and/or modified sequence opt4 from VP1__Norovirus_and/or_Norovirus-like__KX514317
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaccaucgacggcgagcugcugggcaccacccagcugagcagcgugaacaucugcaccuucagaggcgacgugacccaccccagagacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25351 - RNA, 1617 nt, Artificial Sequence
  derived and/or modified sequence opt4 from VP1__Norovirus_and/or_Norovirus-like__KU678204
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25352 - RNA, 1617 nt, Artificial Sequence
  derived and/or modified sequence opt4 from VP1__Norovirus_and/or_Norovirus-like__KX158283
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagacugcccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgaguucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25353 - RNA, 1617 nt, Artificial Sequence
  derived and/or modified sequence opt4 from VP1__Norovirus_and/or_Norovirus-like__KX354088
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcuguucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcggcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25354 - RNA, 1617 nt, Artificial Sequence
  derived and/or modified sequence opt4 from VP1__Norovirus_and/or_Norovirus-like__KX354032
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25355 - RNA, 1617 nt, Artificial Sequence
  derived and/or modified sequence opt4 from VP1__Norovirus_and/or_Norovirus-like__KX354015
augaagauggccagcagcgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggacugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25356 - RNA, 1617 nt, Artificial Sequence
  derived and/or modified sequence opt4 from VP1__Norovirus_and/or_Norovirus-like__KX353999
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagcaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25357 - RNA, 1617 nt, Artificial Sequence
  derived and/or modified sequence opt4 from VP1__Norovirus_and/or_Norovirus-like__KX353987
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25358 - RNA, 1617 nt, Artificial Sequence
  derived and/or modified sequence opt4 from VP1__Norovirus_and/or_Norovirus-like__KX353970
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25359 - RNA, 1617 nt, Artificial Sequence
  derived and/or modified sequence opt4 from VP1__Norovirus_and/or_Norovirus-like__KU985156
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25360 - RNA, 1617 nt, Artificial Sequence
  derived and/or modified sequence opt4 from VP1__Norovirus_and/or_Norovirus-like__KU985155
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25361 - RNA, 1617 nt, Artificial Sequence
  derived and/or modified sequence opt4 from VP1__Norovirus_and/or_Norovirus-like__KM514075
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25362 - RNA, 1617 nt, Artificial Sequence
  derived and/or modified sequence opt4 from VP1__Norovirus_and/or_Norovirus-like__AB972484
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25363 - RNA, 1617 nt, Artificial Sequence
  derived and/or modified sequence opt4 from VP1__Norovirus_and/or_Norovirus-like__KT780391
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25364 - RNA, 1617 nt, Artificial Sequence
  derived and/or modified sequence opt4 from VP1__Norovirus_and/or_Norovirus-like__KT780390
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgaccuggaggccaaccagaacaccaaguucacccccgugggcgugauccaggacggcggcgccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25365 - RNA, 1617 nt, Artificial Sequence
  derived and/or modified sequence opt4 from VP1__Norovirus_and/or_Norovirus-like__KT780376
augaagauggccagcagcgacgccaaccccagcgacggcagcgccgccaaccuggugcccgaggugaacaacgaggugcuggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25366 - RNA, 1617 nt, Artificial Sequence
  derived and/or modified sequence opt4 from VP1__Norovirus_and/or_Norovirus-like__KT780375
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25367 - RNA, 1617 nt, Artificial Sequence
  derived and/or modified sequence opt4 from VP1__Norovirus_and/or_Norovirus-like__LC016607
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccaacacccacaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucaccaccgacaccgacaacgacuucgagaccggccagaacaccagauucacccccgugggcgugauccaggacggcaacggcgcccacagaaacgagccccagcagugggugcugcccgacuacagcggcggcaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25368 - RNA, 1617 nt, Artificial Sequence
  derived and/or modified sequence opt4 from VP1__Norovirus_and/or_Norovirus-like__KP241915
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25369 - RNA, 1617 nt, Artificial Sequence
  derived and/or modified sequence opt4 from VP1__Norovirus_and/or_Norovirus-like__KM514065
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccggcuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25370 - RNA, 1617 nt, Artificial Sequence
  derived and/or modified sequence opt4 from VP1__Norovirus_and/or_Norovirus-like__KM268097
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25371 - RNA, 1617 nt, Artificial Sequence
  derived and/or modified sequence opt4 from VP1__Norovirus_and/or_Norovirus-like__KM268084
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcuggccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccaagaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25372 - RNA, 1617 nt, Artificial Sequence
  derived and/or modified sequence opt4 from VP1__Norovirus_and/or_Norovirus-like__KJ649704
augaagauggccagcagcgacgccaaccccagcgacggcagcgccgccaaccuggugcccgaggugaacaacgaggugcuggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagaauccaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25373 - RNA, 1617 nt, Artificial Sequence
  derived and/or modified sequence opt4 from VP1__Norovirus_and/or_Norovirus-like__KC577174
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagcaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcgccaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25374 - RNA, 1617 nt, Artificial Sequence
  derived and/or modified sequence opt4 from VP1__Norovirus_and/or_Norovirus-like__KF177451
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacaacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25375 - RNA, 1617 nt, Artificial Sequence
  derived and/or modified sequence opt4 from VP1__Norovirus_and/or_Norovirus-like__KF177429
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacagcggccagcacgaccuggugaucccccccaacggcuacuucagauucgacagcugggugaaccaguucuacacccuggcccccaugggcaacggcaccggcagaagaagauga

SEQ ID NO: 25376 - RNA, 1617 nt, Artificial Sequence
  derived and/or modified sequence opt4 from VP1__Norovirus_and/or_Norovirus-like__KF060005
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucacccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25377 - RNA, 1617 nt, Artificial Sequence
  derived and/or modified sequence opt4 from VP1__Norovirus_and/or_Norovirus-like__JX439821
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcagcagcagaaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgacaccgacaccgacaacgacuucgagaccaaccagaacaccaaguucacccccgugggcgugauccaggacggcagcaccaccuacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25378 - RNA, 1617 nt, Artificial Sequence
  derived and/or modified sequence opt4 from VP1__Norovirus_and/or_Norovirus-like__KC517361
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccgugcacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25379 - RNA, 1617 nt, Artificial Sequence
  derived and/or modified sequence opt4 from VP1__Norovirus_and/or_Norovirus-like__KC175378
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugagccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25380 - RNA, 1617 nt, Artificial Sequence
  derived and/or modified sequence opt4 from VP1__Norovirus_and/or_Norovirus-like__JX459648
augaagauggccagcaacgacgccaaccccagcgagggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcaccaucagauggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauucagcaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagagccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugaucccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25381 - RNA, 1617 nt, Artificial Sequence
  derived and/or modified sequence opt4 from VP1__Norovirus_and/or_Norovirus-like__JX459635
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucauccuggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccaccagaagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25382 - RNA, 1617 nt, Artificial Sequence
  derived and/or modified sequence opt4 from VP1__Norovirus_and/or_Norovirus-like__JX459624
augaagauggccagcaacgacgcccaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcccccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25383 - RNA, 1617 nt, Artificial Sequence
  derived and/or modified sequence opt4 from VP1__Norovirus_and/or_Norovirus-like__JX459614
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccaguacgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25384 - RNA, 1617 nt, Artificial Sequence
  derived and/or modified sequence opt4 from VP1__Norovirus_and/or_Norovirus-like__HM635103
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgaccuggagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25385 - RNA, 1617 nt, Artificial Sequence
  derived and/or modified sequence opt4 from VP1__Norovirus_and/or_Norovirus-like__JQ613522
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25386 - RNA, 1617 nt, Artificial Sequence
  derived and/or modified sequence opt4 from VP1__Norovirus_and/or_Norovirus-like__AB629942
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacacccagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcagauacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25387 - RNA, 1617 nt, Artificial Sequence
  derived and/or modified sequence opt4 from VP1__Norovirus_and/or_Norovirus-like__GQ856457
augaagauggccagcaacgacgccaaccccagcgacggccccgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagcaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacacccagaacgacuucgagacccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcagauacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25388 - RNA, 1617 nt, Artificial Sequence
  derived and/or modified sequence opt4 from VP1__Norovirus_and/or_Norovirus-like__EU876883
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccaugagcccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcggcaccacccaccagaacgagccccagcagugggugcugcccaacuacagcggcagagacggccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25389 - RNA, 1617 nt, Artificial Sequence
  derived and/or modified sequence opt4 from VP1__Norovirus_and/or_Norovirus-like__AB447455
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugagcuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25390 - RNA, 1617 nt, Artificial Sequence
  derived and/or modified sequence opt4 from VP1__Norovirus_and/or_Norovirus-like__EU078409
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25391 - RNA, 1617 nt, Artificial Sequence
  derived and/or modified sequence opt4 from VP1__Norovirus_and/or_Norovirus-like__AB303928
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcacccugagaggcgacgugacccacaucgccggcacccacaacuacaccaugaaccuggccagccagaacuggaacaacuacgaccccaccgaggagauccccgccccccugggcacccccgacuucgugggcagaauccagggcgugcugacccagaccaccagaggcgacggcagcaccagaggccacaaggccaccgugagcaccggcgacgugcacuucacccccaagcugggcagcgugcaguucaacaccgacaccaacaacgacuucgagaucggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25392 - RNA, 1617 nt, Artificial Sequence
  derived and/or modified sequence opt4 from VP1__Norovirus_and/or_Norovirus-like__AY502023
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25393 - RNA, 1617 nt, Artificial Sequence
  derived and/or modified sequence opt4 from VP1__Norovirus_and/or_Norovirus-like__KU678202
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccaacaacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25394 - RNA, 1617 nt, Artificial Sequence
  derived and/or modified sequence opt4 from VP1__Norovirus_and/or_Norovirus-like__KX371607
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25395 - RNA, 1617 nt, Artificial Sequence
  derived and/or modified sequence opt4 from VP1__Norovirus_and/or_Norovirus-like__KX354112
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaucggccagcacgaccuggugaucccccccaacggcuacuucagauucgacagcugggugaaccaguucuacacccuggcccccaugggcaacggcaccggcagaagaagauga

SEQ ID NO: 25396 - RNA, 1617 nt, Artificial Sequence
  derived and/or modified sequence opt4 from VP1__Norovirus_and/or_Norovirus-like__KX353993
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcgccaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25397 - RNA, 1617 nt, Artificial Sequence
  derived and/or modified sequence opt4 from VP1__Norovirus_and/or_Norovirus-like__KR131762
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25398 - RNA, 1617 nt, Artificial Sequence
  derived and/or modified sequence opt4 from VP1__Norovirus_and/or_Norovirus-like__AB972519
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25399 - RNA, 1617 nt, Artificial Sequence
  derived and/or modified sequence opt4 from VP1__Norovirus_and/or_Norovirus-like__AB972498
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggagcuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25400 - RNA, 1617 nt, Artificial Sequence
  derived and/or modified sequence opt4 from VP1__Norovirus_and/or_Norovirus-like__AB972488
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgugcccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25401 - RNA, 1617 nt, Artificial Sequence
  derived and/or modified sequence opt4 from VP1__Norovirus_and/or_Norovirus-like__AB972483
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25402 - RNA, 1617 nt, Artificial Sequence
  derived and/or modified sequence opt4 from VP1__Norovirus_and/or_Norovirus-like__KP864106
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25403 - RNA, 1617 nt, Artificial Sequence
  derived and/or modified sequence opt4 from VP1__Norovirus_and/or_Norovirus-like__KR904216
augaagauggccagcagcgacgccaaccccagcgacggcagcaccgccaaccuggcccccgaggugaacaacgaggugauggcccuggagcccguggugggcgccgccaucgccgcccccguggccggccagaagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgcccccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagagagaccuggugaucccccccaacggcuacuucagauucgacagcugggugaaccaguucuacagccuggcccccaugggcaacggcaccggcagaagaagauga

SEQ ID NO: 25404 - RNA, 1617 nt, Artificial Sequence
  derived and/or modified sequence opt4 from VP1__Norovirus_and/or_Norovirus-like__AB933771
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgaggccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25405 - RNA, 1617 nt, Artificial Sequence
  derived and/or modified sequence opt4 from VP1__Norovirus_and/or_Norovirus-like__LC005732
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagauga

SEQ ID NO: 25406 - RNA, 1617 nt, Artificial Sequence
  derived and/or modified sequence opt4 from VP1__Norovirus_and/or_Norovirus-like__KP293591
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccaacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25407 - RNA, 1617 nt, Artificial Sequence
  derived and/or modified sequence opt4 from VP1__Norovirus_and/or_Norovirus-like__KP176396
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccaucgagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25408 - RNA, 1617 nt, Artificial Sequence
  derived and/or modified sequence opt4 from VP1__Norovirus_and/or_Norovirus-like__KP176394
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccgccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25409 - RNA, 1617 nt, Artificial Sequence
  derived and/or modified sequence opt4 from VP1__Norovirus_and/or_Norovirus-like__KP096348
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgacgccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25410 - RNA, 1617 nt, Artificial Sequence
  derived and/or modified sequence opt4 from VP1__Norovirus_and/or_Norovirus-like__KP096344
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25411 - RNA, 1617 nt, Artificial Sequence
  derived and/or modified sequence opt4 from VP1__Norovirus_and/or_Norovirus-like__KM982946
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgagaccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25412 - RNA, 1617 nt, Artificial Sequence
  derived and/or modified sequence opt4 from VP1__Norovirus_and/or_Norovirus-like__KM514070
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacgugaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25413 - RNA, 1617 nt, Artificial Sequence
  derived and/or modified sequence opt4 from VP1__Norovirus_and/or_Norovirus-like__KM514061
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaucauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25414 - RNA, 1617 nt, Artificial Sequence
  derived and/or modified sequence opt4 from VP1__Norovirus_and/or_Norovirus-like__KM514060
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25415 - RNA, 1617 nt, Artificial Sequence
  derived and/or modified sequence opt4 from VP1__Norovirus_and/or_Norovirus-like__KM268079
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25416 - RNA, 1617 nt, Artificial Sequence
  derived and/or modified sequence opt4 from VP1__Norovirus_and/or_Norovirus-like__KJ710247
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccaucgaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccaucggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25417 - RNA, 1617 nt, Artificial Sequence
  derived and/or modified sequence opt4 from VP1__Norovirus_and/or_Norovirus-like__KJ685405
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25418 - RNA, 1617 nt, Artificial Sequence
  derived and/or modified sequence opt4 from VP1__Norovirus_and/or_Norovirus-like__KF429766
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaucaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25419 - RNA, 1617 nt, Artificial Sequence
  derived and/or modified sequence opt4 from VP1__Norovirus_and/or_Norovirus-like__KF060009
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgacgccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25420 - RNA, 1617 nt, Artificial Sequence
  derived and/or modified sequence opt4 from VP1__Norovirus_and/or_Norovirus-like__KF059996
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25421 - RNA, 1617 nt, Artificial Sequence
  derived and/or modified sequence opt4 from VP1__Norovirus_and/or_Norovirus-like__HF952130
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25422 - RNA, 1617 nt, Artificial Sequence
  derived and/or modified sequence opt4 from VP1__Norovirus_and/or_Norovirus-like__KC409302
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaucaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25423 - RNA, 1617 nt, Artificial Sequence
  derived and/or modified sequence opt4 from VP1__Norovirus_and/or_Norovirus-like__JX459908
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacgacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25424 - RNA, 1617 nt, Artificial Sequence
  derived and/or modified sequence opt4 from VP1__Norovirus_and/or_Norovirus-like__JX445166
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25425 - RNA, 1617 nt, Artificial Sequence
  derived and/or modified sequence opt4 from VP1__Norovirus_and/or_Norovirus-like__HQ693090
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucgccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucgcccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25426 - RNA, 1617 nt, Artificial Sequence
  derived and/or modified sequence opt4 from VP1__Norovirus_and/or_Norovirus-like__JN400611
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgaccugaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25427 - RNA, 1617 nt, Artificial Sequence
  derived and/or modified sequence opt4 from VP1__Norovirus_and/or_Norovirus-like__JN400609
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcggcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25428 - RNA, 1617 nt, Artificial Sequence
  derived and/or modified sequence opt4 from VP1__Norovirus_and/or_Norovirus-like__JQ613517
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggaccccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25429 - RNA, 1617 nt, Artificial Sequence
  derived and/or modified sequence opt4 from VP1__Norovirus_and/or_Norovirus-like__JQ478409
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcggcagaagauga

SEQ ID NO: 25430 - RNA, 1617 nt, Artificial Sequence
  derived and/or modified sequence opt4 from VP1__Norovirus_and/or_Norovirus-like__GQ856460
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccgaccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugcccccugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25431 - RNA, 1617 nt, Artificial Sequence
  derived and/or modified sequence opt4 from VP1__Norovirus_and/or_Norovirus-like__GQ856449
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacagcagauucgaccccugggugaaccaguucuacacccuggcccccaugggcaacggcaccggcagaagaagauga

SEQ ID NO: 25432 - RNA, 1617 nt, Artificial Sequence
  derived and/or modified sequence opt4 from VP1__Norovirus_and/or_Norovirus-like__EU921344
augaagauggccagcagcgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcaugcccacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25433 - RNA, 1617 nt, Artificial Sequence
  derived and/or modified sequence opt4 from VP1__Norovirus_and/or_Norovirus-like__AB541290
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagaaccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25434 - RNA, 1617 nt, Artificial Sequence
  derived and/or modified sequence opt4 from VP1__Norovirus_and/or_Norovirus-like__GQ845322
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25435 - RNA, 1617 nt, Artificial Sequence
  derived and/or modified sequence opt4 from VP1__Norovirus_and/or_Norovirus-like__AB220921
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaccaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25436 - RNA, 1617 nt, Artificial Sequence
  derived and/or modified sequence opt4 from VP1__Norovirus_and/or_Norovirus-like__KX514221
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25437 - RNA, 1617 nt, Artificial Sequence
  derived and/or modified sequence opt4 from VP1__Norovirus_and/or_Norovirus-like__KY486271
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25438 - RNA, 1617 nt, Artificial Sequence
  derived and/or modified sequence opt4 from VP1__Norovirus_and/or_Norovirus-like__KP784692
augaagauggccagcagcgacgccaaccccagcgacggcagcaccgccaaccuggugcccgaggugaacaacgaggugauggcccuggagcccguggugggcgccgcccuggccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgagagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacuggagcaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucacccccaagcugggcagagugcaguucgccaccgacaccgaccacgacuucgacaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggaguggguggcccacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25439 - RNA, 1617 nt, Artificial Sequence
  derived and/or modified sequence opt4 from VP1__Norovirus_and/or_Norovirus-like__KX371604
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccaucgcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25440 - RNA, 1617 nt, Artificial Sequence
  derived and/or modified sequence opt4 from VP1__Norovirus_and/or_Norovirus-like__KX354079
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggaggugcccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcagcggcaccggcagaagaagauga

SEQ ID NO: 25441 - RNA, 1617 nt, Artificial Sequence
  derived and/or modified sequence opt4 from VP1__Norovirus_and/or_Norovirus-like__KX354028
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25442 - RNA, 1617 nt, Artificial Sequence
  derived and/or modified sequence opt4 from VP1__Norovirus_and/or_Norovirus-like__KX353983
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucguguucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25443 - RNA, 1617 nt, Artificial Sequence
  derived and/or modified sequence opt4 from VP1__Norovirus_and/or_Norovirus-like__AB972511
augaagauggccagcaacgacgccaaccccagcgacggccccgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaucaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25444 - RNA, 1617 nt, Artificial Sequence
  derived and/or modified sequence opt4 from VP1__Norovirus_and/or_Norovirus-like__AB972478
augaagauggccagcagcgacgccaaccccaccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25445 - RNA, 1617 nt, Artificial Sequence
  derived and/or modified sequence opt4 from VP1__Norovirus_and/or_Norovirus-like__KT780382
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25446 - RNA, 1617 nt, Artificial Sequence
  derived and/or modified sequence opt4 from VP1__Norovirus_and/or_Norovirus-like__KT033905
augaagauggccagcaacgacgccaaccccagcgacggcagcgccgccaaccuggugcccaaggugaacaacgaggugauggcccuggagcccguggugggcgccgccaucgccgcccccguggccggccagcagaacgugaucgaccccuggaucagaaacaacuucgugcaggcccccggcggcaaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25447 - RNA, 1617 nt, Artificial Sequence
  derived and/or modified sequence opt4 from VP1__Norovirus_and/or_Norovirus-like__KR904207
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacagcagccccaagcugggcagagugcaguucgccaccgacaccgacaacgacuucguggccaaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugacccaggcccacaccggccagcacgaccuggugaucccccccaacggcuacuucagauucgacagcugggugaaccaguucuacacccuggcccccaugggcaacggcaccggcagaagaagauga

SEQ ID NO: 25448 - RNA, 1617 nt, Artificial Sequence
  derived and/or modified sequence opt4 from VP1__Norovirus_and/or_Norovirus-like__KJ678151
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25449 - RNA, 1617 nt, Artificial Sequence
  derived and/or modified sequence opt4 from VP1__Norovirus_and/or_Norovirus-like__KJ678143
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25450 - RNA, 1617 nt, Artificial Sequence
  derived and/or modified sequence opt4 from VP1__Norovirus_and/or_Norovirus-like__KP698927
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucggcaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25451 - RNA, 1617 nt, Artificial Sequence
  derived and/or modified sequence opt4 from VP1__Norovirus_and/or_Norovirus-like__LC005730
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25452 - RNA, 1617 nt, Artificial Sequence
  derived and/or modified sequence opt4 from VP1__Norovirus_and/or_Norovirus-like__LC005714
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcacccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25453 - RNA, 1617 nt, Artificial Sequence
  derived and/or modified sequence opt4 from VP1__Norovirus_and/or_Norovirus-like__KP241906
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25454 - RNA, 1617 nt, Artificial Sequence
  derived and/or modified sequence opt4 from VP1__Norovirus_and/or_Norovirus-like__KM982938
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggccugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25455 - RNA, 1617 nt, Artificial Sequence
  derived and/or modified sequence opt4 from VP1__Norovirus_and/or_Norovirus-like__KM514058
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggccugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25456 - RNA, 1617 nt, Artificial Sequence
  derived and/or modified sequence opt4 from VP1__Norovirus_and/or_Norovirus-like__KM198580
augaagauggccagcaacgacgccaaccccaccgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25457 - RNA, 1617 nt, Artificial Sequence
  derived and/or modified sequence opt4 from VP1__Norovirus_and/or_Norovirus-like__KM198537
augaagauggcccccaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggggcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaacggccagcacgaccuggugaucccccccaacggcuacuucagauucgacagcugggugaaccaguucuacacccuggcccccaugggcaacggcaccggcagaagaagauga

SEQ ID NO: 25458 - RNA, 1617 nt, Artificial Sequence
  derived and/or modified sequence opt4 from VP1__Norovirus_and/or_Norovirus-like__KF177450
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugaucccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25459 - RNA, 1617 nt, Artificial Sequence
  derived and/or modified sequence opt4 from VP1__Norovirus_and/or_Norovirus-like__KF008243
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcaccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25460 - RNA, 1617 nt, Artificial Sequence
  derived and/or modified sequence opt4 from VP1__Norovirus_and/or_Norovirus-like__KF429782
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagccccugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccaucgaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcacccacaacuacgccaugaaccuggccgcccagaacuggaacagcuacgaccccaccgaggagauccccgccccccugggcacccccgacuucgugggcaagauccagggcgugcugacccagaccaccagagccgacggcagcaccagagcccacaaggccaccguguacaccggcagcgccgaguucgcccccaagcugggcagagugcaguucgccaccgacaccgacagcgacuucgacaccaaccagaacaccaaguucacccccgugggcgugauccaggacggcaacaccgcccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugagccccuucuacacccuggcccccaugggcaacggcaccggcagaagaagauga

SEQ ID NO: 25461 - RNA, 1617 nt, Artificial Sequence
  derived and/or modified sequence opt4 from VP1__Norovirus_and/or_Norovirus-like__KF060101
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25462 - RNA, 1617 nt, Artificial Sequence
  derived and/or modified sequence opt4 from VP1__Norovirus_and/or_Norovirus-like__KF060096
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccguguucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25463 - RNA, 1617 nt, Artificial Sequence
  derived and/or modified sequence opt4 from VP1__Norovirus_and/or_Norovirus-like__KF060071
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggugagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25464 - RNA, 1617 nt, Artificial Sequence
  derived and/or modified sequence opt4 from VP1__Norovirus_and/or_Norovirus-like__KF060056
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagauga

SEQ ID NO: 25465 - RNA, 1617 nt, Artificial Sequence
  derived and/or modified sequence opt4 from VP1__Norovirus_and/or_Norovirus-like__JX439836
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccagccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25466 - RNA, 1617 nt, Artificial Sequence
  derived and/or modified sequence opt4 from VP1__Norovirus_and/or_Norovirus-like__HF952129
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25467 - RNA, 1617 nt, Artificial Sequence
  derived and/or modified sequence opt4 from VP1__Norovirus_and/or_Norovirus-like__KC409273
augaagauggccagcaacgacgccaaccccagcgacggcagcgccgccagccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25468 - RNA, 1617 nt, Artificial Sequence
  derived and/or modified sequence opt4 from VP1__Norovirus_and/or_Norovirus-like__KC409242
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25469 - RNA, 1617 nt, Artificial Sequence
  derived and/or modified sequence opt4 from VP1__Norovirus_and/or_Norovirus-like__JX445167
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggaggugcccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25470 - RNA, 1617 nt, Artificial Sequence
  derived and/or modified sequence opt4 from VP1__Norovirus_and/or_Norovirus-like__JX445156
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugggcgccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25471 - RNA, 1617 nt, Artificial Sequence
  derived and/or modified sequence opt4 from VP1__Norovirus_and/or_Norovirus-like__GQ856458
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgcccugaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcccacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25472 - RNA, 1617 nt, Artificial Sequence
  derived and/or modified sequence opt4 from VP1__Norovirus_and/or_Norovirus-like__AB541299
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcacagccuguacuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25473 - RNA, 1617 nt, Artificial Sequence
  derived and/or modified sequence opt4 from VP1__Norovirus_and/or_Norovirus-like__AB541195
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcaacgugcaguucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25474 - RNA, 1617 nt, Artificial Sequence
  derived and/or modified sequence opt4 from VP1__Norovirus_and/or_Norovirus-like__AB504322
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccggcuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25475 - RNA, 1617 nt, Artificial Sequence
  derived and/or modified sequence opt4 from VP1__Norovirus_and/or_Norovirus-like__EU876892
augaagauggccagcaacgacgccaaccccagcgacggcagcgccgccaaccuggugcuggaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25476 - RNA, 1617 nt, Artificial Sequence
  derived and/or modified sequence opt4 from VP1__Norovirus_and/or_Norovirus-like__EU876891
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggagaagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25477 - RNA, 1617 nt, Artificial Sequence
  derived and/or modified sequence opt4 from VP1__Norovirus_and/or_Norovirus-like__AB294792
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgacgugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25478 - RNA, 1617 nt, Artificial Sequence
  derived and/or modified sequence opt4 from VP1__Norovirus_and/or_Norovirus-like__AB303932
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcgugcaguucaacaccgacaccaacaacgacuucgagaccggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25479 - RNA, 1617 nt, Artificial Sequence
  derived and/or modified sequence opt4 from VP1__Norovirus_and/or_Norovirus-like__LC177660
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcugggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25480 - RNA, 1617 nt, Artificial Sequence
  derived and/or modified sequence opt4 from VP1__Norovirus_and/or_Norovirus-like__KX608866
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25481 - RNA, 1617 nt, Artificial Sequence
  derived and/or modified sequence opt4 from VP1__Norovirus_and/or_Norovirus-like__KX371603
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25482 - RNA, 1617 nt, Artificial Sequence
  derived and/or modified sequence opt4 from VP1__Norovirus_and/or_Norovirus-like__KX354086
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacgacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25483 - RNA, 1617 nt, Artificial Sequence
  derived and/or modified sequence opt4 from VP1__Norovirus_and/or_Norovirus-like__KX354080
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25484 - RNA, 1617 nt, Artificial Sequence
  derived and/or modified sequence opt4 from VP1__Norovirus_and/or_Norovirus-like__KX354054
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25485 - RNA, 1617 nt, Artificial Sequence
  derived and/or modified sequence opt4 from VP1__Norovirus_and/or_Norovirus-like__KX354041
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagccugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcguggacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25486 - RNA, 1617 nt, Artificial Sequence
  derived and/or modified sequence opt4 from VP1__Norovirus_and/or_Norovirus-like__KX354029
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 25487 - RNA, 1617 nt, Artificial Sequence
  derived and/or modified sequence opt4 from VP1__Norovirus_and/or_Norovirus-like__KX353977
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25488 - RNA, 1617 nt, Artificial Sequence
  derived and/or modified sequence opt4 from VP1__Norovirus_and/or_Norovirus-like__KX353965
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacacccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25489 - RNA, 1617 nt, Artificial Sequence
  derived and/or modified sequence opt4 from VP1__Norovirus_and/or_Norovirus-like__KU311158
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25490 - RNA, 1617 nt, Artificial Sequence
  derived and/or modified sequence opt4 from VP1__Norovirus_and/or_Norovirus-like__AB974408
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccacccccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcaacaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25491 - RNA, 1617 nt, Artificial Sequence
  derived and/or modified sequence opt4 from VP1__Norovirus_and/or_Norovirus-like__KR904221
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcgcccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25492 - RNA, 1617 nt, Artificial Sequence
  derived and/or modified sequence opt4 from VP1__Norovirus_and/or_Norovirus-like__AB933765
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgagccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25493 - RNA, 1617 nt, Artificial Sequence
  derived and/or modified sequence opt4 from VP1__Norovirus_and/or_Norovirus-like__AB933761
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaucaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25494 - RNA, 1617 nt, Artificial Sequence
  derived and/or modified sequence opt4 from VP1__Norovirus_and/or_Norovirus-like__AB933748
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcggcacccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25495 - RNA, 1617 nt, Artificial Sequence
  derived and/or modified sequence opt4 from VP1__Norovirus_and/or_Norovirus-like__EU921386
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugauccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgaggcccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25496 - RNA, 1617 nt, Artificial Sequence
  derived and/or modified sequence opt4 from VP1__Norovirus_and/or_Norovirus-like__KP244321
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcaguggaugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25497 - RNA, 1617 nt, Artificial Sequence
  derived and/or modified sequence opt4 from VP1__Norovirus_and/or_Norovirus-like__KP698923
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccgccgcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25498 - RNA, 1617 nt, Artificial Sequence
  derived and/or modified sequence opt4 from VP1__Norovirus_and/or_Norovirus-like__KP241905
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcauccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25499 - RNA, 1617 nt, Artificial Sequence
  derived and/or modified sequence opt4 from VP1__Norovirus_and/or_Norovirus-like__KP176393
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccagcauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25500 - RNA, 1617 nt, Artificial Sequence
  derived and/or modified sequence opt4 from VP1__Norovirus_and/or_Norovirus-like__KP096330
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25501 - RNA, 1617 nt, Artificial Sequence
  derived and/or modified sequence opt4 from VP1__Norovirus_and/or_Norovirus-like__KM982953
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagaccaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcauccccgacuucgugggcaagauccagggcaugcugacccagaccaccagaaccgacggcagcaccagaggccacaaggccaccguguacaccggcagcguggacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25502 - RNA, 1617 nt, Artificial Sequence
  derived and/or modified sequence opt4 from VP1__Norovirus_and/or_Norovirus-like__KM982936
augaagauggccagcagcgacgccaaccccagcgacggcagcgccgccaaccuggugcccgaggugaacaacgaggugcuggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25503 - RNA, 1617 nt, Artificial Sequence
  derived and/or modified sequence opt4 from VP1__Norovirus_and/or_Norovirus-like__KM514073
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugcugcuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25504 - RNA, 1617 nt, Artificial Sequence
  derived and/or modified sequence opt4 from VP1__Norovirus_and/or_Norovirus-like__KM268086
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcuggccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25505 - RNA, 1617 nt, Artificial Sequence
  derived and/or modified sequence opt4 from VP1__Norovirus_and/or_Norovirus-like__KM198552
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagcaucaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25506 - RNA, 1617 nt, Artificial Sequence
  derived and/or modified sequence opt4 from VP1__Norovirus_and/or_Norovirus-like__KJ716358
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgccgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaucaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25507 - RNA, 1617 nt, Artificial Sequence
  derived and/or modified sequence opt4 from VP1__Norovirus_and/or_Norovirus-like__KJ649702
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25508 - RNA, 1617 nt, Artificial Sequence
  derived and/or modified sequence opt4 from VP1__Norovirus_and/or_Norovirus-like__KF429778
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcggcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25509 - RNA, 1617 nt, Artificial Sequence
  derived and/or modified sequence opt4 from VP1__Norovirus_and/or_Norovirus-like__KF060113
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagagccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25510 - RNA, 1617 nt, Artificial Sequence
  derived and/or modified sequence opt4 from VP1__Norovirus_and/or_Norovirus-like__KF060106
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25511 - RNA, 1617 nt, Artificial Sequence
  derived and/or modified sequence opt4 from VP1__Norovirus_and/or_Norovirus-like__KF060100
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcguggacuucagccccaagcugggcagagugcaguucaccaccgacaccgacaacgacuucgagaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25512 - RNA, 1617 nt, Artificial Sequence
  derived and/or modified sequence opt4 from VP1__Norovirus_and/or_Norovirus-like__KF060069
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25513 - RNA, 1617 nt, Artificial Sequence
  derived and/or modified sequence opt4 from VP1__Norovirus_and/or_Norovirus-like__KF060055
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcuacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 25514 - RNA, 1617 nt, Artificial Sequence
  derived and/or modified sequence opt4 from VP1__Norovirus_and/or_Norovirus-like__KF060028
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucagccccaagcugggcagagugcaguucgccaccgacaccgacaacgacuucguggccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25515 - RNA, 1617 nt, Artificial Sequence
  derived and/or modified sequence opt4 from VP1__Norovirus_and/or_Norovirus-like__KF060022
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcgccuucagaggcgacgugacccacaucagcggcagcagaaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25516 - RNA, 1617 nt, Artificial Sequence
  derived and/or modified sequence opt4 from VP1__Norovirus_and/or_Norovirus-like__KC517376
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcugagcaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25517 - RNA, 1617 nt, Artificial Sequence
  derived and/or modified sequence opt4 from VP1__Norovirus_and/or_Norovirus-like__KC517374
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccacagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcagcggcaccggcagaagaagauga

SEQ ID NO: 25518 - RNA, 1617 nt, Artificial Sequence
  derived and/or modified sequence opt4 from VP1__Norovirus_and/or_Norovirus-like__KC409308
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcaguggaugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25519 - RNA, 1617 nt, Artificial Sequence
  derived and/or modified sequence opt4 from VP1__Norovirus_and/or_Norovirus-like__KC175393
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugagcaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25520 - RNA, 1617 nt, Artificial Sequence
  derived and/or modified sequence opt4 from VP1__Norovirus_and/or_Norovirus-like__JX459623
augaagauggccagcaacgaccccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25521 - RNA, 1617 nt, Artificial Sequence
  derived and/or modified sequence opt4 from VP1__Norovirus_and/or_Norovirus-like__JQ798158
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccuggcccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugggcaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcgcccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25522 - RNA, 1617 nt, Artificial Sequence
  derived and/or modified sequence opt4 from VP1__Norovirus_and/or_Norovirus-like__JQ613566
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccgugccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25523 - RNA, 1617 nt, Artificial Sequence
  derived and/or modified sequence opt4 from VP1__Norovirus_and/or_Norovirus-like__AB541287
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagaaccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25524 - RNA, 1617 nt, Artificial Sequence
  derived and/or modified sequence opt4 from VP1__Norovirus_and/or_Norovirus-like__AB504320
augaagauggccagcaacgacgccaaccccagcgacggcagcgccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcaccagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugaugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25525 - RNA, 1617 nt, Artificial Sequence
  derived and/or modified sequence opt4 from VP1__Norovirus_and/or_Norovirus-like__KU683739
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25526 - RNA, 1617 nt, Artificial Sequence
  derived and/or modified sequence opt4 from VP1__Norovirus_and/or_Norovirus-like__KX354146
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagacugcccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25527 - RNA, 1617 nt, Artificial Sequence
  derived and/or modified sequence opt4 from VP1__Norovirus_and/or_Norovirus-like__KX354075
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacgcccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25528 - RNA, 1617 nt, Artificial Sequence
  derived and/or modified sequence opt4 from VP1__Norovirus_and/or_Norovirus-like__KX354072
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaagggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccccagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucgccaccgacaccgagaacgacuucgagacccaccagaacaccagauucacccccgugggcgugauccaggacggcagcaccacccacagaaacgagccccagcagugggugcugcccagcuacagcggcagaaacgugcacaacgugcaccuggcccccgccguggcccccaacuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25529 - RNA, 1617 nt, Artificial Sequence
  derived and/or modified sequence opt4 from VP1__Norovirus_and/or_Norovirus-like__KX354060
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25530 - RNA, 1617 nt, Artificial Sequence
  derived and/or modified sequence opt4 from VP1__Norovirus_and/or_Norovirus-like__KX353959
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcgccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25531 - RNA, 1617 nt, Artificial Sequence
  derived and/or modified sequence opt4 from VP1__Norovirus_and/or_Norovirus-like__KX353954
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaagcauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25532 - RNA, 1617 nt, Artificial Sequence
  derived and/or modified sequence opt4 from VP1__Norovirus_and/or_Norovirus-like__AB972529
augaagauggccagcagcgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25533 - RNA, 1617 nt, Artificial Sequence
  derived and/or modified sequence opt4 from VP1__Norovirus_and/or_Norovirus-like__AB972504
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25534 - RNA, 1617 nt, Artificial Sequence
  derived and/or modified sequence opt4 from VP1__Norovirus_and/or_Norovirus-like__AB972503
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25535 - RNA, 1617 nt, Artificial Sequence
  derived and/or modified sequence opt4 from VP1__Norovirus_and/or_Norovirus-like__KP244322
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccagagacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcggcaccacccacagaaacgagccccagcagugggugcugcccaacuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25536 - RNA, 1617 nt, Artificial Sequence
  derived and/or modified sequence opt4 from VP1__Norovirus_and/or_Norovirus-like__LC018706
augaagauggccagcagcgacgccaaccccagcgacggcagcgccgccaaccuggugcccgaggugaacaacgaggacauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccaacuucagccccaagcugggcagagugcaguucgagaccgacaccgaccacgacuucgaggugaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25537 - RNA, 1617 nt, Artificial Sequence
  derived and/or modified sequence opt4 from VP1__Norovirus_and/or_Norovirus-like__KP096345
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggggcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25538 - RNA, 1617 nt, Artificial Sequence
  derived and/or modified sequence opt4 from VP1__Norovirus_and/or_Norovirus-like__KM982939
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 25539 - RNA, 1617 nt, Artificial Sequence
  derived and/or modified sequence opt4 from VP1__Norovirus_and/or_Norovirus-like__KM198588
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggcccugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25540 - RNA, 1617 nt, Artificial Sequence
  derived and/or modified sequence opt4 from VP1__Norovirus_and/or_Norovirus-like__KM198544
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccaccugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25541 - RNA, 1617 nt, Artificial Sequence
  derived and/or modified sequence opt4 from VP1__Norovirus_and/or_Norovirus-like__KM198522
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugagagugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25542 - RNA, 1617 nt, Artificial Sequence
  derived and/or modified sequence opt4 from VP1__Norovirus_and/or_Norovirus-like__KM198508
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25543 - RNA, 1617 nt, Artificial Sequence
  derived and/or modified sequence opt4 from VP1__Norovirus_and/or_Norovirus-like__KJ716367
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcaucgugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25544 - RNA, 1617 nt, Artificial Sequence
  derived and/or modified sequence opt4 from VP1__Norovirus_and/or_Norovirus-like__KF177440
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccagcauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25545 - RNA, 1617 nt, Artificial Sequence
  derived and/or modified sequence opt4 from VP1__Norovirus_and/or_Norovirus-like__KF060117
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25546 - RNA, 1617 nt, Artificial Sequence
  derived and/or modified sequence opt4 from VP1__Norovirus_and/or_Norovirus-like__KF060104
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccagcuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25547 - RNA, 1617 nt, Artificial Sequence
  derived and/or modified sequence opt4 from VP1__Norovirus_and/or_Norovirus-like__KF060095
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacagcgacuucgugaccaaccagaacaccaaguucacccccgugggcgugauccaggacggcagcaccacccccagaaacgagccccagcagugggugcugcccagcuacagcggcagaagcacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25548 - RNA, 1617 nt, Artificial Sequence
  derived and/or modified sequence opt4 from VP1__Norovirus_and/or_Norovirus-like__KF060084
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25549 - RNA, 1617 nt, Artificial Sequence
  derived and/or modified sequence opt4 from VP1__Norovirus_and/or_Norovirus-like__KF060082
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaguacgaccuggugaucccccccaacggcuacuucagauucgacagcugggugaaccaguucuacacccuggcccccaugggcaacggcaccggcagaagaagauga

SEQ ID NO: 25550 - RNA, 1617 nt, Artificial Sequence
  derived and/or modified sequence opt4 from VP1__Norovirus_and/or_Norovirus-like__KF060079
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25551 - RNA, 1617 nt, Artificial Sequence
  derived and/or modified sequence opt4 from VP1__Norovirus_and/or_Norovirus-like__KF060058
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccagcaccauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25552 - RNA, 1617 nt, Artificial Sequence
  derived and/or modified sequence opt4 from VP1__Norovirus_and/or_Norovirus-like__KF060039
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25553 - RNA, 1617 nt, Artificial Sequence
  derived and/or modified sequence opt4 from VP1__Norovirus_and/or_Norovirus-like__KF060030
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggaacgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgccaccguggcccacaccggccagcacgaccuggugaucccccccaacggcuacuucagauucgacagcugggugaaccaguucuacacccuggcccccaugggcaacggcaccggcagaagaagauga

SEQ ID NO: 25554 - RNA, 1617 nt, Artificial Sequence
  derived and/or modified sequence opt4 from VP1__Norovirus_and/or_Norovirus-like__JX439829
augaagaugggcagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25555 - RNA, 1617 nt, Artificial Sequence
  derived and/or modified sequence opt4 from VP1__Norovirus_and/or_Norovirus-like__KC409282
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25556 - RNA, 1617 nt, Artificial Sequence
  derived and/or modified sequence opt4 from VP1__Norovirus_and/or_Norovirus-like__KC409259
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25557 - RNA, 1617 nt, Artificial Sequence
  derived and/or modified sequence opt4 from VP1__Norovirus_and/or_Norovirus-like__JX459659
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25558 - RNA, 1617 nt, Artificial Sequence
  derived and/or modified sequence opt4 from VP1__Norovirus_and/or_Norovirus-like__JX459658
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucaucgugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25559 - RNA, 1617 nt, Artificial Sequence
  derived and/or modified sequence opt4 from VP1__Norovirus_and/or_Norovirus-like__JX459595
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugauccccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagagcuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25560 - RNA, 1617 nt, Artificial Sequence
  derived and/or modified sequence opt4 from VP1__Norovirus_and/or_Norovirus-like__JQ613560
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25561 - RNA, 1617 nt, Artificial Sequence
  derived and/or modified sequence opt4 from VP1__Norovirus_and/or_Norovirus-like__JQ613545
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacaacuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25562 - RNA, 1617 nt, Artificial Sequence
  derived and/or modified sequence opt4 from VP1__Norovirus_and/or_Norovirus-like__AB541288
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccccuggagcgccccccugggccccgaccugaaccccuaccugagccaccuggccagaauguacaacggcuacgccggcggcuucgaggugcagguggugcuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcacccccuucacccccaagcugggcagcgugcaguucagcaccgacaccgagaacgacuucgagaaccaccagaacaccaaguucacccccgugggcgugauccaggacggcggcaccacccacagaaacgagccccagcagugggugcugcccagcuacagcggcagaaacgugcagaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25563 - RNA, 1617 nt, Artificial Sequence
  derived and/or modified sequence opt4 from VP1__Norovirus_and/or_Norovirus-like__AB541247
augaagauggccagcaacgacgccaacagaagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaagcgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25564 - RNA, 1617 nt, Artificial Sequence
  derived and/or modified sequence opt4 from VP1__Norovirus_and/or_Norovirus-like__EU839585
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugccccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcacccacagaaacgagccccagcagugggugcugcccgacuacagcggcagaaccguguacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25565 - RNA, 1617 nt, Artificial Sequence
  derived and/or modified sequence opt4 from VP1__Norovirus_and/or_Norovirus-like__AY588021
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccagauucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccacccccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25566 - RNA, 1617 nt, Artificial Sequence
  derived and/or modified sequence opt4 from VP1__Norovirus_and/or_Norovirus-like__KX514188
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggacaagcuguucaccggccccagcagcgccaacguggugcagccccagaacggcagaugcaccaucgacggcgagcugcugggcaccacccagcugagccccgugaacaucugcaccuucagaggcgacgugacccaccccagagacagccagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25567 - RNA, 1617 nt, Artificial Sequence
  derived and/or modified sequence opt4 from VP1__Norovirus_and/or_Norovirus-like__KX354101
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25568 - RNA, 1617 nt, Artificial Sequence
  derived and/or modified sequence opt4 from VP1__Norovirus_and/or_Norovirus-like__KX354023
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggccccccccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25569 - RNA, 1617 nt, Artificial Sequence
  derived and/or modified sequence opt4 from VP1__Norovirus_and/or_Norovirus-like__KX353979
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25570 - RNA, 1617 nt, Artificial Sequence
  derived and/or modified sequence opt4 from VP1__Norovirus_and/or_Norovirus-like__AB972491
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25571 - RNA, 1617 nt, Artificial Sequence
  derived and/or modified sequence opt4 from VP1__Norovirus_and/or_Norovirus-like__AB972469
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcacccugagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25572 - RNA, 1617 nt, Artificial Sequence
  derived and/or modified sequence opt4 from VP1__Norovirus_and/or_Norovirus-like__LC101819
augaagauggccagcaacgacgacaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaacaaguucuacacccuggcccccaugggcaacggcaccggcagaagaagauga

SEQ ID NO: 25573 - RNA, 1617 nt, Artificial Sequence
  derived and/or modified sequence opt4 from VP1__Norovirus_and/or_Norovirus-like__KT202795
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcggcaccacccacagaaacgagccccagcagugggugcugcccagcuacagcggcagaaacauccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25574 - RNA, 1617 nt, Artificial Sequence
  derived and/or modified sequence opt4 from VP1__Norovirus_and/or_Norovirus-like__AB933742
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcuggaucaaccaguucuacacccuggcccccaugggcaacggcaccggcagaagaagauga

SEQ ID NO: 25575 - RNA, 1617 nt, Artificial Sequence
  derived and/or modified sequence opt4 from VP1__Norovirus_and/or_Norovirus-like__AB933722
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagagccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccccaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25576 - RNA, 1617 nt, Artificial Sequence
  derived and/or modified sequence opt4 from VP1__Norovirus_and/or_Norovirus-like__KJ678138
augaagauggccagcagcgacgccaaccccagcgacggcagcgccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25577 - RNA, 1617 nt, Artificial Sequence
  derived and/or modified sequence opt4 from VP1__Norovirus_and/or_Norovirus-like__KP244317
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccagacuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguuccacacccuggcccccaugggcaacggcaccggcagaagaagauga

SEQ ID NO: 25578 - RNA, 1617 nt, Artificial Sequence
  derived and/or modified sequence opt4 from VP1__Norovirus_and/or_Norovirus-like__KP698925
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguaccuguaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25579 - RNA, 1617 nt, Artificial Sequence
  derived and/or modified sequence opt4 from VP1__Norovirus_and/or_Norovirus-like__LC005727
augaagauggccagcagcgacgccaacccccccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25580 - RNA, 1617 nt, Artificial Sequence
  derived and/or modified sequence opt4 from VP1__Norovirus_and/or_Norovirus-like__LC016603
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagcaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcggcgcccacagaaacgagccccagcagugggugcugcccgacuacagcggcaagaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25581 - RNA, 1617 nt, Artificial Sequence
  derived and/or modified sequence opt4 from VP1__Norovirus_and/or_Norovirus-like__LC016599
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccagcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25582 - RNA, 1617 nt, Artificial Sequence
  derived and/or modified sequence opt4 from VP1__Norovirus_and/or_Norovirus-like__KP293587
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcugaagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacagcuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugagaaacggcaccggcagaagaagauga

SEQ ID NO: 25583 - RNA, 1617 nt, Artificial Sequence
  derived and/or modified sequence opt4 from VP1__Norovirus_and/or_Norovirus-like__KP176402
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaaccuggugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25584 - RNA, 1617 nt, Artificial Sequence
  derived and/or modified sequence opt4 from VP1__Norovirus_and/or_Norovirus-like__KJ196287
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggccacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25585 - RNA, 1617 nt, Artificial Sequence
  derived and/or modified sequence opt4 from VP1__Norovirus_and/or_Norovirus-like__KM198480
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcuguacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25586 - RNA, 1617 nt, Artificial Sequence
  derived and/or modified sequence opt4 from VP1__Norovirus_and/or_Norovirus-like__KJ716357
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggccacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25587 - RNA, 1617 nt, Artificial Sequence
  derived and/or modified sequence opt4 from VP1__Norovirus_and/or_Norovirus-like__KJ716354
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25588 - RNA, 1617 nt, Artificial Sequence
  derived and/or modified sequence opt4 from VP1__Norovirus_and/or_Norovirus-like__KJ685403
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucaccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25589 - RNA, 1617 nt, Artificial Sequence
  derived and/or modified sequence opt4 from VP1__Norovirus_and/or_Norovirus-like__KF060108
augaagauggccagcagcgacgccaaccccagcgacggcagcagcgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25590 - RNA, 1617 nt, Artificial Sequence
  derived and/or modified sequence opt4 from VP1__Norovirus_and/or_Norovirus-like__KF060099
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25591 - RNA, 1617 nt, Artificial Sequence
  derived and/or modified sequence opt4 from VP1__Norovirus_and/or_Norovirus-like__KF060004
augaagauggccagcagcgacgccaaccccagcgacggcagcguggccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25592 - RNA, 1617 nt, Artificial Sequence
  derived and/or modified sequence opt4 from VP1__Norovirus_and/or_Norovirus-like__KF060006
augaagauggccagcagcgacgccaaccccagcgacggcagcaccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaucaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25593 - RNA, 1617 nt, Artificial Sequence
  derived and/or modified sequence opt4 from VP1__Norovirus_and/or_Norovirus-like__KC517371
augaagauggccagcaacgacgccaaccccagcgacggcagcgccgccaaccuggugcccgagguggacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggccccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25594 - RNA, 1617 nt, Artificial Sequence
  derived and/or modified sequence opt4 from VP1__Norovirus_and/or_Norovirus-like__JX459657
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25595 - RNA, 1617 nt, Artificial Sequence
  derived and/or modified sequence opt4 from VP1__Norovirus_and/or_Norovirus-like__JX459656
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25596 - RNA, 1617 nt, Artificial Sequence
  derived and/or modified sequence opt4 from VP1__Norovirus_and/or_Norovirus-like__JX445152
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgaggccggccagaacaccaaguucacccccgacggcguggugcaggacggcaacggcacccaccagaacgagccccagcagugggugcugcccagcuacagcggcagaaccggccacaacgugcaccuggcccccgccaucgcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25597 - RNA, 1617 nt, Artificial Sequence
  derived and/or modified sequence opt4 from VP1__Norovirus_and/or_Norovirus-like__JQ613553
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccgugcaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25598 - RNA, 1617 nt, Artificial Sequence
  derived and/or modified sequence opt4 from VP1__Norovirus_and/or_Norovirus-like__JQ613521
augaagauggccagcaacgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagagacuacaccaugaaccuggccagccugaacuggaacaacuacgaccccaccgaggagacccccgccccccugggcacccccgacuucgugggcaagauccagggcaugcugacccagaccaccaagggcgacggcagcaccagaggccacaaggccaccguguacaccggcagcgcccccuucacccccaagcugggcagcgugagauucagcaccgacaccgagaacgacuucgagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25599 - RNA, 1617 nt, Artificial Sequence
  derived and/or modified sequence opt4 from VP1__Norovirus_and/or_Norovirus-like__HQ005298
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25600 - RNA, 1617 nt, Artificial Sequence
  derived and/or modified sequence opt4 from VP1__Norovirus_and/or_Norovirus-like__HQ005296
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25601 - RNA, 1617 nt, Artificial Sequence
  derived and/or modified sequence opt4 from VP1__Norovirus_and/or_Norovirus-like__HM802555
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25602 - RNA, 1617 nt, Artificial Sequence
  derived and/or modified sequence opt4 from VP1__Norovirus_and/or_Norovirus-like__GQ246801
augaagauggccagcagcgacgcccaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggccuacaccggccagcacgaccuggugaucccccccaacggcuacuucagauucgacagcugggugaaccaguucuacacccuggcccccaugggcaacggcaccggcagaagaagauga

SEQ ID NO: 25603 - RNA, 1617 nt, Artificial Sequence
  derived and/or modified sequence opt4 from VP1__Norovirus_and/or_Norovirus-like__AB504308
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcacccacggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25604 - RNA, 1617 nt, Artificial Sequence
  derived and/or modified sequence opt4 from VP1__Norovirus_and/or_Norovirus-like__DQ369797
augaagauggcccccaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacauccccggcaccagaaucuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25605 - RNA, 1617 nt, Artificial Sequence
  derived and/or modified sequence opt4 from VP1__Norovirus_and/or_Norovirus-like__LC177661
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagcaccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25606 - RNA, 1617 nt, Artificial Sequence
  derived and/or modified sequence opt4 from VP1__Norovirus_and/or_Norovirus-like__LC175468
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25607 - RNA, 1617 nt, Artificial Sequence
  derived and/or modified sequence opt4 from VP1__Norovirus_and/or_Norovirus-like__KX354137
augaagauggccagcagcgacgccaaccccagcgacggcagcgccgccaaccuggugcccgaggugagcaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaagcgacggcagcaccagaggccacaaggccaccguguacaccggcagcgccgacuucgcccccaagcugggcagagugcaguucgagaccgacaccgacagagacuucgagaccaaccagaacaccaaguucacccccgugggcgugauccaggacggcaccaccgcccacagaaacgagccccagcagugggugcugcccagcuacagcggcagaaacauccacaacgugcaccuggcccccgccguggcccccaccuuccccggcgagcagcugcugagcuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25608 - RNA, 1617 nt, Artificial Sequence
  derived and/or modified sequence opt4 from VP1__Norovirus_and/or_Norovirus-like__KX354036
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcagccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25609 - RNA, 1617 nt, Artificial Sequence
  derived and/or modified sequence opt4 from VP1__Norovirus_and/or_Norovirus-like__KX354011
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25610 - RNA, 1617 nt, Artificial Sequence
  derived and/or modified sequence opt4 from VP1__Norovirus_and/or_Norovirus-like__LC153122
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggugagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25611 - RNA, 1617 nt, Artificial Sequence
  derived and/or modified sequence opt4 from VP1__Norovirus_and/or_Norovirus-like__KR131777
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggagcagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25612 - RNA, 1617 nt, Artificial Sequence
  derived and/or modified sequence opt4 from VP1__Norovirus_and/or_Norovirus-like__AB933764
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25613 - RNA, 1617 nt, Artificial Sequence
  derived and/or modified sequence opt4 from VP1__Norovirus_and/or_Norovirus-like__LC016600
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagcaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcggcgcccacagaaacgagccccagcagugggugcugcccaacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25614 - RNA, 1617 nt, Artificial Sequence
  derived and/or modified sequence opt4 from VP1__Norovirus_and/or_Norovirus-like__KJ433970
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcagauacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25615 - RNA, 1617 nt, Artificial Sequence
  derived and/or modified sequence opt4 from VP1__Norovirus_and/or_Norovirus-like__KP176395
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcguggacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25616 - RNA, 1617 nt, Artificial Sequence
  derived and/or modified sequence opt4 from VP1__Norovirus_and/or_Norovirus-like__KM982947
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgccguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25617 - RNA, 1617 nt, Artificial Sequence
  derived and/or modified sequence opt4 from VP1__Norovirus_and/or_Norovirus-like__KJ685414
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25618 - RNA, 1617 nt, Artificial Sequence
  derived and/or modified sequence opt4 from VP1__Norovirus_and/or_Norovirus-like__KF060093
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcaacaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25619 - RNA, 1617 nt, Artificial Sequence
  derived and/or modified sequence opt4 from VP1__Norovirus_and/or_Norovirus-like__KC456070
augaagauggccagcagcgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccaagauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaccaucggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25620 - RNA, 1617 nt, Artificial Sequence
  derived and/or modified sequence opt4 from VP1__Norovirus_and/or_Norovirus-like__KC409299
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25621 - RNA, 1617 nt, Artificial Sequence
  derived and/or modified sequence opt4 from VP1__Norovirus_and/or_Norovirus-like__JX984947
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagcagcgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaccugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccaucuacaccggcagcgcccccuucacccccaagcugggcagcgugcaguucaacaccgacaccgagaacgacuucgagacccaccagaacaccaaguucacccccgugggcgugauccaggacggcggcaccacccacagaaacgagccccagcagugggugcugcccagcuacagcggcagaaacauccccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25622 - RNA, 1617 nt, Artificial Sequence
  derived and/or modified sequence opt4 from VP1__Norovirus_and/or_Norovirus-like__KC175385
augaagauggccagcagcgacgccaaccccagcaacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccagcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuuccagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25623 - RNA, 1617 nt, Artificial Sequence
  derived and/or modified sequence opt4 from VP1__Norovirus_and/or_Norovirus-like__JQ613563
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacacccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25624 - RNA, 1617 nt, Artificial Sequence
  derived and/or modified sequence opt4 from VP1__Norovirus_and/or_Norovirus-like__JQ613558
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaucggccaguacgaccuggugaucccccccaacggcuacuucagauucgacagcugggugaaccaguucuacacccuggcccccaugggcaacggcaccggcagaagaagauga

SEQ ID NO: 25625 - RNA, 1617 nt, Artificial Sequence
  derived and/or modified sequence opt4 from VP1__Norovirus_and/or_Norovirus-like__GQ856451
augaagauggccagcaacgacgccaaccccagcgacggcagcguggccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgacagcaccaucaagcugaucgccaugcuguacaccccccugagagccgacaacgccggcgaggacguguucaccgugagcugcagagugcugaccagacccagccccgacuucgacuucaucuuccuggugccccccaccguggagagcaagaccaagcccuucaccgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacagcagauucgacagcugggugaaccaguucuacacccuggcccccaugggcaacggcaccggcagaagaagauga

SEQ ID NO: 25626 - RNA, 1617 nt, Artificial Sequence
  derived and/or modified sequence opt4 from VP1__Norovirus_and/or_Norovirus-like__DQ419908
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcuggacagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25627 - RNA, 1617 nt, Artificial Sequence
  derived and/or modified sequence opt4 from VP1__Norovirus_and/or_Norovirus-like__KX514354
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcacccugguggugcagccccagaacggcagaugcaugaucgacggcgugcugcugggcaccacccagcugagccccgugaacaucugcaccuucagaggcgacgugacccacagcagagacagcaccaucuacaccaugaaccuggccagccccaacuggaacaacuacgaccccaccgaggagauccccgccccccugggcacccccgacuucgugggcaagauccagggcgugcugacccagaccaccaagggcgagggcagcaccagaggccacagagccaccguguacgugggcagcgccaacuacacccccaagcugggcaaggugcaguucgagaccaacaccaccaacgaccuguacgcccaccagaacaccagauucacccccgugggcguggugcagggcggcgagagcgcccacagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25628 - RNA, 1617 nt, Artificial Sequence
  derived and/or modified sequence opt4 from VP1__Norovirus_and/or_Norovirus-like__KX354062
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccaacagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25629 - RNA, 1617 nt, Artificial Sequence
  derived and/or modified sequence opt4 from VP1__Norovirus_and/or_Norovirus-like__AB972532
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25630 - RNA, 1617 nt, Artificial Sequence
  derived and/or modified sequence opt4 from VP1__Norovirus_and/or_Norovirus-like__KT202796
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggacgccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25631 - RNA, 1617 nt, Artificial Sequence
  derived and/or modified sequence opt4 from VP1__Norovirus_and/or_Norovirus-like__AB933751
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaacaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25632 - RNA, 1617 nt, Artificial Sequence
  derived and/or modified sequence opt4 from VP1__Norovirus_and/or_Norovirus-like__KM514078
augaagauggccagcagcgacgccaaccccagcgacggcagcgccgccaaccuggugcccgaggugaacaacgaggugcuggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25633 - RNA, 1617 nt, Artificial Sequence
  derived and/or modified sequence opt4 from VP1__Norovirus_and/or_Norovirus-like__KM198569
augaagauggccagcaacgacgccaaccccagcgacggcagcgccgccaaccuggugcccgaggugagcaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagaccaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25634 - RNA, 1617 nt, Artificial Sequence
  derived and/or modified sequence opt4 from VP1__Norovirus_and/or_Norovirus-like__KF768522
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25635 - RNA, 1617 nt, Artificial Sequence
  derived and/or modified sequence opt4 from VP1__Norovirus_and/or_Norovirus-like__KF060120
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggaacgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcaagugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25636 - RNA, 1617 nt, Artificial Sequence
  derived and/or modified sequence opt4 from VP1__Norovirus_and/or_Norovirus-like__KF060102
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcaacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25637 - RNA, 1617 nt, Artificial Sequence
  derived and/or modified sequence opt4 from VP1__Norovirus_and/or_Norovirus-like__KF060088
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25638 - RNA, 1617 nt, Artificial Sequence
  derived and/or modified sequence opt4 from VP1__Norovirus_and/or_Norovirus-like__KF060025
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucguggccgaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25639 - RNA, 1617 nt, Artificial Sequence
  derived and/or modified sequence opt4 from VP1__Norovirus_and/or_Norovirus-like__KC517378
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugggcaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25640 - RNA, 1617 nt, Artificial Sequence
  derived and/or modified sequence opt4 from VP1__Norovirus_and/or_Norovirus-like__JX459640
augaagauggccagcagcgacgccaaccccagcgacggcagcaccgcccaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25641 - RNA, 1617 nt, Artificial Sequence
  derived and/or modified sequence opt4 from VP1__Norovirus_and/or_Norovirus-like__JQ613512
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacgccugggugaaccaguucuacacccuggcccccaugggcaacggcaccggcagaaagagauga

SEQ ID NO: 25642 - RNA, 1617 nt, Artificial Sequence
  derived and/or modified sequence opt4 from VP1__Norovirus_and/or_Norovirus-like__HQ005299
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25643 - RNA, 1617 nt, Artificial Sequence
  derived and/or modified sequence opt4 from VP1__Norovirus_and/or_Norovirus-like__AB541312
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacugcauccuggaccugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25644 - RNA, 1617 nt, Artificial Sequence
  derived and/or modified sequence opt4 from VP1__Norovirus_and/or_Norovirus-like__AB541275
augaagauggccagcagcgacgccaacccccccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaagcuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuuccagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25645 - RNA, 1617 nt, Artificial Sequence
  derived and/or modified sequence opt4 from VP1__Norovirus_and/or_Norovirus-like__AB303930
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaaccuguaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccggcgaggagaugaccaacagcagauuccccaucccccuggagaagcuguucaccggccccagcggcgccuucguggugcagccccagaacggcagaugcaccaccgacggcgugcugcugggcaccacccagcugcugcccgugaacaucugcaccuucagaggcgacgugacccacaucgccggcacccacaacuacaccaugaaccuggccagccagaacuggaacaacuacgaccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccagccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25646 - RNA, 1617 nt, Artificial Sequence
  derived and/or modified sequence opt4 from VP1__Norovirus_and/or_Norovirus-like__AY485642
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugccccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcacccacaacuacaccaugaaccuggccagccagaacuggaacaacuacggccccaccgaggagauccccgccccccugggcacccccgacuucgugggcagaauccagggcaugcugacccagaccaccagaggcgacggcagcaccagaggccacaaggccaccgugagcaccggcgacgugcacuucacccccaagcugggcagcauccaguucaacaccgacaccaacaacgacuucgagaccggccagaacaccaaguucacccccgugggcguggugcaggacggcaacggcacccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25647 - RNA, 1617 nt, Artificial Sequence
  derived and/or modified sequence opt4 from VP1__Norovirus_and/or_Norovirus-like__KX514343
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagaaccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25648 - RNA, 1617 nt, Artificial Sequence
  derived and/or modified sequence opt4 from VP1__Norovirus_and/or_Norovirus-like__KX514274
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgugacccuggacaagcuguucaccggccccagcagcaccaucguggugcagccccagaacggcagaugcaccaucgacggcgugcugcugggcaccacccagcugagccccgugaacaucugcaccuucagaggcgacgugacccaccccagagacagcaccaucuacaccaugaaccuggccagccccaacuggaacaccuacgaccccaccgaggagauccccgccccccugggcacccccgacuucgugggcaagauccagggcaugcugacccagaccaccaagggcgccggcagcaccagaggccacagagccaccguguacgugggcagcgccaacuacgcccccaagcugggcagagugcaguucgagaccaacaccagcgacgaccuggacgcccaccagaacaccaaguucacccccgugggcgugauccagggcggcgagagcgcccacagaagcgagccccagcagugggugcugcccagcuacagcggcagagacauccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25649 - RNA, 1617 nt, Artificial Sequence
  derived and/or modified sequence opt4 from VP1__Norovirus_and/or_Norovirus-like__KX514175
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25650 - RNA, 1617 nt, Artificial Sequence
  derived and/or modified sequence opt4 from VP1__Norovirus_and/or_Norovirus-like__KX354093
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggagcagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25651 - RNA, 1617 nt, Artificial Sequence
  derived and/or modified sequence opt4 from VP1__Norovirus_and/or_Norovirus-like__KX354003
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25652 - RNA, 1617 nt, Artificial Sequence
  derived and/or modified sequence opt4 from VP1__Norovirus_and/or_Norovirus-like__KR131778
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccgaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25653 - RNA, 1617 nt, Artificial Sequence
  derived and/or modified sequence opt4 from VP1__Norovirus_and/or_Norovirus-like__AB972468
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgugcccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25654 - RNA, 1617 nt, Artificial Sequence
  derived and/or modified sequence opt4 from VP1__Norovirus_and/or_Norovirus-like__KR904222
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacugcgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25655 - RNA, 1617 nt, Artificial Sequence
  derived and/or modified sequence opt4 from VP1__Norovirus_and/or_Norovirus-like__KP244320
augaagauggccagcagcgacgccaaccccagcgacggcagcaccgccaaccuggugcccgaggugaacaacgaggugauggcccuggagcccguggugggcgccagcaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugccccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacuaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagagccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25656 - RNA, 1617 nt, Artificial Sequence
  derived and/or modified sequence opt4 from VP1__Norovirus_and/or_Norovirus-like__KP244315
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucguggugcaggugauccuggccggcaacgccuucaccgccggcaagaucaucuucgccgccgugccccccaacuuccccaccgagggccugagccccagccaggugaccauguucccccacaucaucguggacgccagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccaagaccgacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25657 - RNA, 1617 nt, Artificial Sequence
  derived and/or modified sequence opt4 from VP1__Norovirus_and/or_Norovirus-like__KP244314
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgugggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuuccaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagaauccaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25658 - RNA, 1617 nt, Artificial Sequence
  derived and/or modified sequence opt4 from VP1__Norovirus_and/or_Norovirus-like__KM268078
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25659 - RNA, 1617 nt, Artificial Sequence
  derived and/or modified sequence opt4 from VP1__Norovirus_and/or_Norovirus-like__KM198555
augaagauggccagcagcgacgccaaccccagcgacggcagcaccgccagccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagagcuggaacagcuacgaccccaccgaggagauccccgccccccugggcagccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25660 - RNA, 1617 nt, Artificial Sequence
  derived and/or modified sequence opt4 from VP1__Norovirus_and/or_Norovirus-like__KF060115
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25661 - RNA, 1617 nt, Artificial Sequence
  derived and/or modified sequence opt4 from VP1__Norovirus_and/or_Norovirus-like__KF060018
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25662 - RNA, 1617 nt, Artificial Sequence
  derived and/or modified sequence opt4 from VP1__Norovirus_and/or_Norovirus-like__KC517365
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcuggacaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgcccaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccgccgcccacaccggccagcacgaccuggugaucccccccaacggcuacuucagauucgacagcugggugaaccaguucuacacccuggcccccaugggcaacggcaccggcagaagaagauga

SEQ ID NO: 25663 - RNA, 1617 nt, Artificial Sequence
  derived and/or modified sequence opt4 from VP1__Norovirus_and/or_Norovirus-like__KC517360
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcaugcugacccagaccgccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcugccccgacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccugaucaucccccccaacggcuacuucagauucgacagcugggugaaccaguucuacacccuggcccccaugggcaacggcaccggcagaagaagauga

SEQ ID NO: 25664 - RNA, 1617 nt, Artificial Sequence
  derived and/or modified sequence opt4 from VP1__Norovirus_and/or_Norovirus-like__JX846928
augaagauggccagcagcgacgccagccccagcgacggcagcaccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagcugaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcaacaccacccccagaaacgagccccagcagugggugcugcccagcuacagcggcagaaacauccagaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25665 - RNA, 1617 nt, Artificial Sequence
  derived and/or modified sequence opt4 from VP1__Norovirus_and/or_Norovirus-like__JX459904
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcaugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25666 - RNA, 1617 nt, Artificial Sequence
  derived and/or modified sequence opt4 from VP1__Norovirus_and/or_Norovirus-like__JX459649
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauucagcaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25667 - RNA, 1617 nt, Artificial Sequence
  derived and/or modified sequence opt4 from VP1__Norovirus_and/or_Norovirus-like__JX459643
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagaguggaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25668 - RNA, 1617 nt, Artificial Sequence
  derived and/or modified sequence opt4 from VP1__Norovirus_and/or_Norovirus-like__JX459602
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccuggacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagacccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25669 - RNA, 1617 nt, Artificial Sequence
  derived and/or modified sequence opt4 from VP1__Norovirus_and/or_Norovirus-like__LC177655
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagagccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccccccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25670 - RNA, 1617 nt, Artificial Sequence
  derived and/or modified sequence opt4 from VP1__Norovirus_and/or_Norovirus-like__KP784698
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucacccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25671 - RNA, 1617 nt, Artificial Sequence
  derived and/or modified sequence opt4 from VP1__Norovirus_and/or_Norovirus-like__KX354104
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25672 - RNA, 1617 nt, Artificial Sequence
  derived and/or modified sequence opt4 from VP1__Norovirus_and/or_Norovirus-like__KR904211
augaagauggccagcagcgacgccaaccccagcgacggcagcaccgccaaccuggugcccgaggugaacaacgaggugauggcccuggagcccguggugggcgccgccaucgccgcccccguggccggccagcagaacgccaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgacgccaaccagaacaccaaguucacccccgugggcgugauccaggacggcggcaccacccacagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25673 - RNA, 1617 nt, Artificial Sequence
  derived and/or modified sequence opt4 from VP1__Norovirus_and/or_Norovirus-like__AB933743
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaagcauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25674 - RNA, 1617 nt, Artificial Sequence
  derived and/or modified sequence opt4 from VP1__Norovirus_and/or_Norovirus-like__LN854572
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25675 - RNA, 1617 nt, Artificial Sequence
  derived and/or modified sequence opt4 from VP1__Norovirus_and/or_Norovirus-like__KP244319
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugagcaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25676 - RNA, 1617 nt, Artificial Sequence
  derived and/or modified sequence opt4 from VP1__Norovirus_and/or_Norovirus-like__KF768470
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugagcaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25677 - RNA, 1617 nt, Artificial Sequence
  derived and/or modified sequence opt4 from VP1__Norovirus_and/or_Norovirus-like__KC456073
augaagauggccagcagcgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25678 - RNA, 1617 nt, Artificial Sequence
  derived and/or modified sequence opt4 from VP1__Norovirus_and/or_Norovirus-like__KC456072
augaagauggccagcagcgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25679 - RNA, 1617 nt, Artificial Sequence
  derived and/or modified sequence opt4 from VP1__Norovirus_and/or_Norovirus-like__JX459622
augaagauggccagcaacgacgcccaccccagcgacggcagcgccgccacccuggugcccaaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagcugcacgugcugcuggccggcaacgccuucaccgccggcaagaucaucaucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaucuucagaggcgacgugacccacaucgccggcagcagaaacuacaccaugaaccuggccgcccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgccgacuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25680 - RNA, 1617 nt, Artificial Sequence
  derived and/or modified sequence opt4 from VP1__Norovirus_and/or_Norovirus-like__KX514290
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25681 - RNA, 1617 nt, Artificial Sequence
  derived and/or modified sequence opt4 from VP1__Norovirus_and/or_Norovirus-like__KP784695
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcaacaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25682 - RNA, 1617 nt, Artificial Sequence
  derived and/or modified sequence opt4 from VP1__Norovirus_and/or_Norovirus-like__KX608865
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25683 - RNA, 1617 nt, Artificial Sequence
  derived and/or modified sequence opt4 from VP1__Norovirus_and/or_Norovirus-like__AB972500
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25684 - RNA, 1617 nt, Artificial Sequence
  derived and/or modified sequence opt4 from VP1__Norovirus_and/or_Norovirus-like__KT033902
augaagauggccagcagcgacgccaaccccagcgacggcagcaccgccaaccugauccccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacaucuucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25685 - RNA, 1617 nt, Artificial Sequence
  derived and/or modified sequence opt4 from VP1__Norovirus_and/or_Norovirus-like__KR904220
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggugggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagccacaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcaccgacuucacccccaagcugggcagagcccaguucgccaccgacaccgacaacgacuucgagaccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25686 - RNA, 1617 nt, Artificial Sequence
  derived and/or modified sequence opt4 from VP1__Norovirus_and/or_Norovirus-like__LN854566
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugagccacaucaccggcagcagaaacuacaccaugaaccuggccagccagaacuggaacaacuacgaccccaccgaggagauccccgccccccugggcacccccgacuucgugggcaagauccagggcaugcugacccagaccaccagagccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25687 - RNA, 1617 nt, Artificial Sequence
  derived and/or modified sequence opt4 from VP1__Norovirus_and/or_Norovirus-like__KP244313
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccaggccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25688 - RNA, 1617 nt, Artificial Sequence
  derived and/or modified sequence opt4 from VP1__Norovirus_and/or_Norovirus-like__KP096342
augaagauggccagcagcgacgccaaccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25689 - RNA, 1617 nt, Artificial Sequence
  derived and/or modified sequence opt4 from VP1__Norovirus_and/or_Norovirus-like__KM514067
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccccgagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25690 - RNA, 1617 nt, Artificial Sequence
  derived and/or modified sequence opt4 from VP1__Norovirus_and/or_Norovirus-like__KF060049
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25691 - RNA, 1617 nt, Artificial Sequence
  derived and/or modified sequence opt4 from VP1__Norovirus_and/or_Norovirus-like__KF059998
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcgccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcaacaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25692 - RNA, 1617 nt, Artificial Sequence
  derived and/or modified sequence opt4 from VP1__Norovirus_and/or_Norovirus-like__JX439833
augaagauggccagcagcgacgccaaccccagcgacggcagcaaggccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagcagaagauga

SEQ ID NO: 25693 - RNA, 1617 nt, Artificial Sequence
  derived and/or modified sequence opt4 from VP1__Norovirus_and/or_Norovirus-like__JQ613548
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccgccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25694 - RNA, 1617 nt, Artificial Sequence
  derived and/or modified sequence opt4 from VP1__Norovirus_and/or_Norovirus-like__JN595867
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagacccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25695 - RNA, 1617 nt, Artificial Sequence
  derived and/or modified sequence opt4 from VP1__Norovirus_and/or_Norovirus-like__AB629944
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcagcuacgugaccguggcccacaccggccagcacgaccuggugaucccccccaacggcuacuucagauucgacagcugggugaaccaguucuacacccuggcccccaugggcaacggcaccggcagaagacacuga

SEQ ID NO: 25696 - RNA, 1617 nt, Artificial Sequence
  derived and/or modified sequence opt4 from VP1__Norovirus_and/or_Norovirus-like__AB541192
augaagauggccagcagcgacgccaacccccccgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgacgccacccacaucgccggcagcagaagcuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucagcaccgacaccgagaacgacuuccagacccaccagaacaccaaguucacccccgugggcgugauccaggacggcagcaccacccacagaaacgagccccagcagugggugcugcccagcuacagcggcagagacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25697 - RNA, 1617 nt, Artificial Sequence
  derived and/or modified sequence opt4 from VP1__Norovirus_and/or_Norovirus-like__AB504314
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcagaauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccugagaaacgagccccagcagugggugcugcccgacuacagcggcagaaccgugcacaacgugcaccuggcccccgccguggcccugaccuuccccggcgagcagcugcuguucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacagagccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25698 - RNA, 1617 nt, Artificial Sequence
  derived and/or modified sequence opt4 from VP1__Norovirus_and/or_Norovirus-like__KX514350
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25699 - RNA, 1617 nt, Artificial Sequence
  derived and/or modified sequence opt4 from VP1__Norovirus_and/or_Norovirus-like__KX514342
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25700 - RNA, 1617 nt, Artificial Sequence
  derived and/or modified sequence opt4 from VP1__Norovirus_and/or_Norovirus-like__KX514280
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgugacccuggacaagcuguucaccggccccagcagcaccaucguggugcagccccagaacggcagaugcaccaucgacggcgugcugcugggcaccacccagcugagccccgugaacaucugcaccuucagaggcgacgugacccaccccagagacagcaccaucuacaccaugaaccuggccagccccaacuggaacaccuacgaccccaccgaggagauccccgccccccugggcacccccgacuucgugggcaagauccagggcaugcugacccagaccaccaagggcgccggcagcaccagaggccacagagccaccguguacgugggcagcgccaacuacgcccccaagcugggcagagugcaguucgagaccaacaccagcgacgaccuggacgcccaccagaacaccaaguucacccccgugggcgugauccagggcggcgagagcgcccacagaagcgagccccagcagugggugcugcccagcuacagcggcagagacauccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25701 - RNA, 1617 nt, Artificial Sequence
  derived and/or modified sequence opt4 from VP1__Norovirus_and/or_Norovirus-like__LC177654
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25702 - RNA, 1617 nt, Artificial Sequence
  derived and/or modified sequence opt4 from VP1__Norovirus_and/or_Norovirus-like__KX354026
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25703 - RNA, 1617 nt, Artificial Sequence
  derived and/or modified sequence opt4 from VP1__Norovirus_and/or_Norovirus-like__KR904218
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguuccccagaaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcagcaccgacggcgugcugcugggcaccacccagcugagccccgugaacaucugcaccuucagaggcgacgugacccacaucgccggcagccacaacuacaccaugaaccuggccagccagaacuggagcagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccaacaacgacuucgagagcaaccagaacaccaaguucgcccccgugggcgugauccaggacggcggcaccgcccacagaaacgagccccagcagugggugcugcccagcuacagcggcagaaacauccacaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25704 - RNA, 1617 nt, Artificial Sequence
  derived and/or modified sequence opt4 from VP1__Norovirus_and/or_Norovirus-like__KJ678150
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25705 - RNA, 1617 nt, Artificial Sequence
  derived and/or modified sequence opt4 from VP1__Norovirus_and/or_Norovirus-like__KJ678148
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25706 - RNA, 1617 nt, Artificial Sequence
  derived and/or modified sequence opt4 from VP1__Norovirus_and/or_Norovirus-like__KP244316
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagacccagggcgugcugacccagaccaccaagaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagagacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacagacugcugccccaggagugggugcaguacuucuaccaggagcccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25707 - RNA, 1617 nt, Artificial Sequence
  derived and/or modified sequence opt4 from VP1__Norovirus_and/or_Norovirus-like__KF060072
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucaucaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25708 - RNA, 1617 nt, Artificial Sequence
  derived and/or modified sequence opt4 from VP1__Norovirus_and/or_Norovirus-like__JX439822
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagcagaagauga

SEQ ID NO: 25709 - RNA, 1617 nt, Artificial Sequence
  derived and/or modified sequence opt4 from VP1__Norovirus_and/or_Norovirus-like__KC463910
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucagcaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25710 - RNA, 1617 nt, Artificial Sequence
  derived and/or modified sequence opt4 from VP1__Norovirus_and/or_Norovirus-like__JX459651
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauucagcaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25711 - RNA, 1617 nt, Artificial Sequence
  derived and/or modified sequence opt4 from VP1__Norovirus_and/or_Norovirus-like__AB541314
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggugguguucaccgugagcugcagagugcugaccagacccagccccgacuucgacuucaucugccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagcccggcuacgugaccguggcccacaccggccagcacgaccuggugauccccagcaacggcuacuucagauucgacagcugggugaaccaguucuacacccuggcccccaugggcaacggcaccggcagaagaagauga

SEQ ID NO: 25712 - RNA, 1617 nt, Artificial Sequence
  derived and/or modified sequence opt4 from VP1__Norovirus_and/or_Norovirus-like__AB504323
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucaucgacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccuggacuucgacuucaucuuccuggugccccccaccguggagagcagaaccaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcacccugagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcagaaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25713 - RNA, 1617 nt, Artificial Sequence
  derived and/or modified sequence opt4 from VP1__Norovirus_and/or_Norovirus-like__KX353963
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccaggacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25714 - RNA, 1617 nt, Artificial Sequence
  derived and/or modified sequence opt4 from VP1__Norovirus_and/or_Norovirus-like__KR904213
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuucagccuggcccccaugggcaacggcaccggcagaagaagauga

SEQ ID NO: 25715 - RNA, 1617 nt, Artificial Sequence
  derived and/or modified sequence opt4 from VP1__Norovirus_and/or_Norovirus-like__AB933745
augaagauggccagcaaccacgugaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaucaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25716 - RNA, 1617 nt, Artificial Sequence
  derived and/or modified sequence opt4 from VP1__Norovirus_and/or_Norovirus-like__KP096341
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcaugcugacccagaccaccagaaccgacggcagcaccagaggccacaaggccaccguguacaucggcggcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25717 - RNA, 1617 nt, Artificial Sequence
  derived and/or modified sequence opt4 from VP1__Norovirus_and/or_Norovirus-like__KM114291
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcccgcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcgccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgacagagacuucgaggccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25718 - RNA, 1617 nt, Artificial Sequence
  derived and/or modified sequence opt4 from VP1__Norovirus_and/or_Norovirus-like__KF060105
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25719 - RNA, 1617 nt, Artificial Sequence
  derived and/or modified sequence opt4 from VP1__Norovirus_and/or_Norovirus-like__KF060081
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25720 - RNA, 1617 nt, Artificial Sequence
  derived and/or modified sequence opt4 from VP1__Norovirus_and/or_Norovirus-like__KF059999
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggagaccgcccccgcccagagcgacguggcccugcugagauucgugaaccccgacaccggcagagugcuguucgagugcaagcugcacaagagcugcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25721 - RNA, 1617 nt, Artificial Sequence
  derived and/or modified sequence opt4 from VP1__Norovirus_and/or_Norovirus-like__JX644036
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25722 - RNA, 1617 nt, Artificial Sequence
  derived and/or modified sequence opt4 from VP1__Norovirus_and/or_Norovirus-like__JX459654
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccuggacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25723 - RNA, 1617 nt, Artificial Sequence
  derived and/or modified sequence opt4 from VP1__Norovirus_and/or_Norovirus-like__JN400621
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugauguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25724 - RNA, 1617 nt, Artificial Sequence
  derived and/or modified sequence opt4 from VP1__Norovirus_and/or_Norovirus-like__AB541260
augaagauggccagcaacgacgccaaccccagcgacggcagcgccgccaaccuggugcccgaggugaacaacgaggugauggcccuggagcccguggugggcgccgccaucgccgcccccguggccgcccagcagaacgugaucgaccccuggaucagaaacaacuucgugcaggcccccggcggcgaguucaccgugagccccagaaacgcccccagcgagauccuguggagcgccccccugggccccgaccugaaccccuaccugagccacuucgccagaauguacaacugcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25725 - RNA, 1617 nt, Artificial Sequence
  derived and/or modified sequence opt4 from VP1__Norovirus_and/or_Norovirus-like__KX514341
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25726 - RNA, 1617 nt, Artificial Sequence
  derived and/or modified sequence opt4 from VP1__Norovirus_and/or_Norovirus-like__KX514253
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccggccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugaaccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcaaccugguggugcagccccagaacggcagaugcaugaucgacggcgugcugcugggcaccacccagcugagccccgugaacaucugcaccuucagaggcgacgugacccaccugagagacagcaccaucuacaccaugaaccuggccagccccaacuggaacaacuacgaccccaccgaggagauccccgccccccugggcacccccgacuucgugggcaagauccagggcgugcugacccagaccaccaagggcgagggcagcaccagaggccacagagccaccguguacgugggcagcgccgacuacacccccaagcugggcaaggugcaguucgagaccaacaccaccaacgaccuguacgcccaccagaacaccaaguucacccccgugggcguggugcagggcggcgagagcgcccacagaagcgagccccagcagugggugcugcccggcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25727 - RNA, 1617 nt, Artificial Sequence
  derived and/or modified sequence opt4 from VP1__Norovirus_and/or_Norovirus-like__KX514195
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcacccugguggugcagccccagaacggcagaugcaugaucgacggcgugcugcugggcaccacccagcugagccccgugaacaucugcaccuucagaggcgacgugacccacagcagagacagcaccaucuacaccaugaaccuggccagccccaacuggaacaacuacgaccccaccgaggagauccccgccccccugggcacccccgacuucgugggcaagauccagggcgugcugacccagaccaccaagggcgagggcagcaccagaggccacagagccaccguguacgugggcagcgccaacuacacccccaagcugggcaaggugcaguucgagaccaacaccaccaacgaccuguacgcccaccagaacaccagauucacccccgugggcguggugcagggcggcgagagcgcccacagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25728 - RNA, 1617 nt, Artificial Sequence
  derived and/or modified sequence opt4 from VP1__Norovirus_and/or_Norovirus-like__KX354016
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcggcgugacccacauccccggcagccacaacuacaccaugaaccuggccagccagaacuggagcagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25729 - RNA, 1617 nt, Artificial Sequence
  derived and/or modified sequence opt4 from VP1__Norovirus_and/or_Norovirus-like__KM245073
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccaccugaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25730 - RNA, 1617 nt, Artificial Sequence
  derived and/or modified sequence opt4 from VP1__Norovirus_and/or_Norovirus-like__LN854567
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgacuucguggugcagccccagaacggcagaugcaccaccgacggcgugcugcugggcaccacccagcugagccccgugaacaucugcaccuucagaggcgacgugacccacaccaccggcagcagaaacuacaccaugaaccuggccagccagaacuggaacaacuacgaccccaccgaggagacccccgccccccugggcacccccgacuucgugggcaagaucagaggcaugcugacccagaccaccagagccgacggcagcaccagaggccacaaggccaccguguacaccggcagcgccgacuucgcccccaagcugggcagagugcaguucgagaccgacaccgacaacgacuucgacgccaaccagaacaccaaguucacccccgugggcgugauccaggacggcaccaccacccacagaaacgagcccagacagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguucuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 25731 - RNA, 1617 nt, Artificial Sequence
  derived and/or modified sequence opt4 from VP1__Norovirus_and/or_Norovirus-like__JN400619
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccugcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25732 - RNA, 1617 nt, Artificial Sequence
  derived and/or modified sequence opt4 from VP1__Norovirus_and/or_Norovirus-like__KF060052
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgugaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25733 - RNA, 1617 nt, Artificial Sequence
  derived and/or modified sequence opt4 from VP1__Norovirus_and/or_Norovirus-like__KF060014
augaagauggccagcagcgacgccaaccccagcgacggcagcaccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacagcgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25734 - RNA, 1617 nt, Artificial Sequence
  derived and/or modified sequence opt4 from VP1__Norovirus_and/or_Norovirus-like__KC517375
augaagauggccagcagcgacgccaaccccagcgacggcagcgccgccaaccuggugcccgaggugaacaacgaggugauggcccuggagcccguggccggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacgccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25735 - RNA, 1617 nt, Artificial Sequence
  derived and/or modified sequence opt4 from VP1__Norovirus_and/or_Norovirus-like__JX644039
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcagcagaaacuacaccaugaaccuggccagccagaacuggaccagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25736 - RNA, 1617 nt, Artificial Sequence
  derived and/or modified sequence opt4 from VP1__Norovirus_and/or_Norovirus-like__JX644031
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggagcagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25737 - RNA, 1617 nt, Artificial Sequence
  derived and/or modified sequence opt4 from VP1__Norovirus_and/or_Norovirus-like__HM191773
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgccgagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25738 - RNA, 1617 nt, Artificial Sequence
  derived and/or modified sequence opt4 from VP1__Norovirus_and/or_Norovirus-like__AB504309
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagauucaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25739 - RNA, 1617 nt, Artificial Sequence
  derived and/or modified sequence opt4 from VP1__Norovirus_and/or_Norovirus-like__KX514216
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccugagagacagccccaucuacaccaugaaccuggccagccccaacuggaacaacuacgacagcaccgaggagauccccgccccccugggcacccccgacuucgugggcaagauccagggcgugcugacccagaccaccaagggcgagggcagcaccagaggccacagagccaccguguacgugggcagcgccaacuacacccccaagcugggcaaggugcaguucgagaccaacaccaccaacgaccuguacgcccaccagaacaccaaguucacccccgugggcguggugcagggcggcgagagcgcccacagaagcgagccccagcagugggugcugcccggcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25740 - RNA, 1617 nt, Artificial Sequence
  derived and/or modified sequence opt4 from VP1__Norovirus_and/or_Norovirus-like__KX514212
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcaaccugguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcgugcugacccagaccaccaagggcgagggcagcaccagaggccacagagccaccguguacgugggcagcgccaacuacacccccaagcugggcaaggugcaguucgagaccaacaccaccaacgaccuguacgcccaccagaacaccaaguucacccccgugggcguggugcagggcggcgagagcgcccacagaagcgagccccagcagugggugcugcccggcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25741 - RNA, 1617 nt, Artificial Sequence
  derived and/or modified sequence opt4 from VP1__Norovirus_and/or_Norovirus-like__KX354138
augaagauggccagcagcgacgccaaccccagcgacggcagcgccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgccggccugagccccagccaggugaccauguuccccagcaucgugguggacgugagacagcuggagcccgugcugaucccccugcccgacgugagaaacaacuucuaccacuacaaccagagcaacgaccccaccaucacccugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacaucacccacaucaccggcagccacaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgccgacuucagccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25742 - RNA, 1617 nt, Artificial Sequence
  derived and/or modified sequence opt4 from VP1__Norovirus_and/or_Norovirus-like__AB933747
augaagauggccagcagcgacgccaaccccuucgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25743 - RNA, 1617 nt, Artificial Sequence
  derived and/or modified sequence opt4 from VP1__Norovirus_and/or_Norovirus-like__KJ955493
augaagauggccagcagcgacgccaaccccagcgacggcagcgccgccaaccuggugcccgaggugaacaacgaggugauggcccuggagcccuucgugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccugaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaagcgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25744 - RNA, 1617 nt, Artificial Sequence
  derived and/or modified sequence opt4 from VP1__Norovirus_and/or_Norovirus-like__KJ678153
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcacccugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25745 - RNA, 1617 nt, Artificial Sequence
  derived and/or modified sequence opt4 from VP1__Norovirus_and/or_Norovirus-like__KC456071
augaagauggccagcagcgacgccaacccccccgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcgaguucaccgugagccccaagaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagagacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25746 - RNA, 1617 nt, Artificial Sequence
  derived and/or modified sequence opt4 from VP1__Norovirus_and/or_Norovirus-like__KC175384
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacugggacagcuacgaccccaccgaggagacccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25747 - RNA, 1617 nt, Artificial Sequence
  derived and/or modified sequence opt4 from VP1__Norovirus_and/or_Norovirus-like__JQ613561
augaagauggccagcagcgacgccaaccccagcgacggcagcaccgccaaccuggugcccgaggugaacaccgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacgccgcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25748 - RNA, 1617 nt, Artificial Sequence
  derived and/or modified sequence opt4 from VP1__Norovirus_and/or_Norovirus-like__KJ678145
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgagagcugggugaaccaguucuacacccuggcccccaugggcaacggcaccggcagaagaagauga

SEQ ID NO: 25749 - RNA, 1617 nt, Artificial Sequence
  derived and/or modified sequence opt4 from VP1__Norovirus_and/or_Norovirus-like__KF060116
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagacccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25750 - RNA, 1617 nt, Artificial Sequence
  derived and/or modified sequence opt4 from VP1__Norovirus_and/or_Norovirus-like__KC517362
augaagauggccagcagcgacgccaaccccagcgacggcagcgccgccaaccuggugcccgaggugaacaacgaggugaucgcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacaucgcccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaaccugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25751 - RNA, 1617 nt, Artificial Sequence
  derived and/or modified sequence opt4 from VP1__Norovirus_and/or_Norovirus-like__JX644038
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacgugugcaccuucagaggcgacgugacccacaucagcggcagcagaaacuacaccaugaaccuggccagccagaacuggaccagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25752 - RNA, 1617 nt, Artificial Sequence
  derived and/or modified sequence opt4 from VP1__Norovirus_and/or_Norovirus-like__AB504313
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccagaggcgacggccugaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucguggaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25753 - RNA, 1617 nt, Artificial Sequence
  derived and/or modified sequence opt4 from VP1__Norovirus_and/or_Norovirus-like__KX514361
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcaaggacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25754 - RNA, 1617 nt, Artificial Sequence
  derived and/or modified sequence opt4 from VP1__Norovirus_and/or_Norovirus-like__KX514336
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccacagcggcaacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25755 - RNA, 1617 nt, Artificial Sequence
  derived and/or modified sequence opt4 from VP1__Norovirus_and/or_Norovirus-like__KX514203
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcacccugguggugcagccccagaacggcagaugcaugaucgacggcgugcugcugggcaccacccagcugagccccgugaacaucugcaccuucagaggcgacgugacccacagcagagacagcaccaucuacaccaugaaccuggccagccccaacuggaacaacuacgaccccaccgaggagauccccgccccccugggcacccccgacuucgugggcaagauccagggcgugcugacccagaccaccaagggcgagggcagcaccagaggccacagagccaccguguacgugggcagcgccaacuacacccccaagcugggcaaggugcaguucgagaccaacaccaccaacgaccuguacgcccaccagaacaccagauucacccccgugggcguggugcagggcggcgagagcgcccacagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25756 - RNA, 1617 nt, Artificial Sequence
  derived and/or modified sequence opt4 from VP1__Norovirus_and/or_Norovirus-like__KP784693
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgagggcgugcugcugggcaccacccagcugagccccgugaacaucugcaccuucagaggcgacgugacccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25757 - RNA, 1617 nt, Artificial Sequence
  derived and/or modified sequence opt4 from VP1__Norovirus_and/or_Norovirus-like__AB933734
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcgagaccaagcccuucuucuuccccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25758 - RNA, 1617 nt, Artificial Sequence
  derived and/or modified sequence opt4 from VP1__Norovirus_and/or_Norovirus-like__KF060041
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucggcgugcaggugauccuggccggcaacgccuucaccgccggcaaggugaucuucgccgccgugccccccaacuuccccaccgagggccugagccccagccaggugaccauguucccccacaucguggugaacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagacccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccugaccggccagcacgaccuggugaucccccccaacggcuacuucagauucgacagcugggugaaccaguucuacacccuggcccccaugggcaacggcaccggcagaagaagauga

SEQ ID NO: 25759 - RNA, 1617 nt, Artificial Sequence
  derived and/or modified sequence opt4 from VP1__Norovirus_and/or_Norovirus-like__JX989074
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagacccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25760 - RNA, 1617 nt, Artificial Sequence
  derived and/or modified sequence opt4 from VP1__Norovirus_and/or_Norovirus-like__JN400624
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacgacagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacagcgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25761 - RNA, 1617 nt, Artificial Sequence
  derived and/or modified sequence opt4 from VP1__Norovirus_and/or_Norovirus-like__EU876894
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccagaaucagaaacaacuucgugcaggcccccggcggcgaguucaccgugagccccagaaacgcccccggcgagauccuguggagcgccccccugggccccgaccugaaccccuaccugagccaccuggccagaauguacaacagcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcugggugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccaggaguacaccaugaaccuggccagccagaacuggaacaacuacgaccccaccgaggagauccccgccccccugggcacccccgacuucgugggcaagauccagggcgugcugacccagaccaccagaagcgacggcagcaccagaggccacaaggccaccgugagcaccggcagcgugcacuucacccccaagcugggcagaauccaguucagcaccgacaccagcaacgacuucgagaccggccagaacaccagauucacccccgugggcguggugcaggacggcagcaccacccaccagaacgagccccagcagugggugcugcccaacuacagcggcagagacagccacaacgugcaccuggcccccgccguggcccccagcuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25762 - RNA, 1617 nt, Artificial Sequence
  derived and/or modified sequence opt4 from VP1__Norovirus_and/or_Norovirus-like__KX514173
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccaccagacacuggaccaugaaccuggccagccccaacuggaacaacuacgaccccaccgaggagacccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25763 - RNA, 1617 nt, Artificial Sequence
  derived and/or modified sequence opt4 from VP1__Norovirus_and/or_Norovirus-like__KX353989
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauggugccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagccacaacuacaccaugaaccuggccagccagaacuggaacagcuacgaccccaccgaggagauccccgccccccugggcacccccgacuucgugggcaagauccagggcgugcugacccagaccaccagcaccaacggcagcaccagaggccacaaggccaccguguacaccggcagcgccgacuucagccccaagcugggcagagugcaguucgccaccgacaccaacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25764 - RNA, 1617 nt, Artificial Sequence
  derived and/or modified sequence opt4 from VP1__Norovirus_and/or_Norovirus-like__KX353962
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaaccccagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccaggacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25765 - RNA, 1617 nt, Artificial Sequence
  derived and/or modified sequence opt4 from VP1__Norovirus_and/or_Norovirus-like__AB972515
augaagauggccagcagcgacgccaaccccagcgacggcagcaccgccaaccuggugcccgaggugaacaacgaggugauggcccuggagcccgugaucggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaugaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25766 - RNA, 1617 nt, Artificial Sequence
  derived and/or modified sequence opt4 from VP1__Norovirus_and/or_Norovirus-like__KT033904
augaagauggccagcaacgacgccaaccccagcgacggcagcgccgccaaccuggugcccaaggugaacaacgaggugauggcccuggagcccguggugggcgccgccaucgccgcccccguggccggccagcagaacgugaucgaccccuggaucaagaacaacuucgugcaggcccccggcggcaaguucaccgugagccccaagaacgcccccggcgagauccuguggagcgccccccugggccccgaccugaaccccuaccugagccaccuggccagaauguacaagggccacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25767 - RNA, 1617 nt, Artificial Sequence
  derived and/or modified sequence opt4 from VP1__Norovirus_and/or_Norovirus-like__KM982942
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagccacaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccaaccacgacuucgaggccaaccagaacaccaaguucacccccgugggcgugauccaggacggcggcaccacccacagaaacgagccccagcagugggugcugcccagcuacagcggcagaaacacccccaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcagagugaaccaguucuacacccuggcccccaugggcaacggcaccggcagaagaagauga

SEQ ID NO: 25768 - RNA, 1617 nt, Artificial Sequence
  derived and/or modified sequence opt4 from VP1__Norovirus_and/or_Norovirus-like__KJ685417
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugauccacaucagcggcagcagaaacuacaccaugaaccuggccagccagaacuggaacagcuacgaccccaccgaggagauccccgccccccugggcacccccgacuucgugggcaagauccagggcgugcugacccagaccaccagaaccgacggcagcaccagaggccacaaggccaccguguacaccggcagcgccgacuucagccccaagcugggcagagugcaguucgccaccgacaccgacaacgacuucgugaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25769 - RNA, 1617 nt, Artificial Sequence
  derived and/or modified sequence opt4 from VP1__Norovirus_and/or_Norovirus-like__KC907392
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagaagccccaucccccuggagaagcuguucaccggccccagcagcgccuucguggugcagccccagaacggcagaugcaccaccgacggcgugcugcugggcaccacccagcugagccccgugaacaucugcaccuucagaggcgacguggcccacaucgccggcacccagaacuacaccaugaaccuggccagccagaacuggaacaacuacgaccccaccgaggagauccccgccccccugggcacccccaacuucgugggcaagauccagggcgugcugacccagaccaccaagagagacggcagcaccagaggcagaaaggccaccgugagcaccggcagcgugcacuucacccccaagcugggcagcgugcaguucagcaccgacaccagcaacgacuucgagaccggccagaacaccagauucacccccgugggcguggugcaggacggcagcaccacccacagaaacgagccccagcagugggugcugcccgacuacagcggcagagacagccacaacgugcaccuggcccccgccguggcccccaccuuccccggcgagcagcugcuguucuucagaagcagcaugcccggcugcagcggcuaccccaacauggaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacagcagauucgacagcugggugaaccaguucuacacccuggcccccaugggcaacggcgccggcagaagaagauga

SEQ ID NO: 25770 - RNA, 1617 nt, Artificial Sequence
  derived and/or modified sequence opt4 from VP1__Norovirus_and/or_Norovirus-like__KC517377
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgaccccaccaucaagcugaucgccaugcuguacgccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccaacaccggcagagugcuguucgagugcaagcugcacaagagcggcuacgugaccguggcccacaccggccagcacgaccuggugaucccccccaacgacuacuucagauucgacagcugggugaaccaguucuacacccuggcccccaugggcaacggcaccggcagaagaagauga

SEQ ID NO: 25771 - RNA, 1617 nt, Artificial Sequence
  derived and/or modified sequence opt4 from VP1__Norovirus_and/or_Norovirus-like__KC517368
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgcccaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccgagaacgccuucaccgccggcaagaucaucuucgccgccgugccccccaacuuccccaccgagggccugagccccagcagagugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaccaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgugcccaccgaggagauccccgccccccugggcacccccgacuucgugggcaaggugcagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25772 - RNA, 1617 nt, Artificial Sequence
  derived and/or modified sequence opt4 from VP1__Norovirus_and/or_Norovirus-like__AB541310
augaagaugagaagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccggcagcugcagagugcugaccagacccagccccgacuucgacuucaucuuccuggugccccccaccguggagagcagaaccaagcccuucagcgugagcuucuucaccggcgaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccacccagaacuggaacagcuacgaccccaccgaggagauccccgccccccugggcacccccgacuucgugggcaagauccagggcgugcugacccagaccaccagagccgacggcagcaccagaggccacaaggccaccguguacaccggcagcgccgacuucgcccccaagcugggcagagugcaguucgccaccgacaccgacaacgacuucgacgccaaccagaacaccaaguucacccccgugggcgugauccaggacggcgacaccgcccacagaaacgagccccagcagugggugcugcccagcuacagcggcagaaacagccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25773 - RNA, 1617 nt, Artificial Sequence
  derived and/or modified sequence opt4 from VP1__Norovirus_and/or_Norovirus-like__EF535854
augaagauggccaccaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgagguggaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaucagcggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccgacaacgacuucgagaccggccagaacaccagauucacccccgugggcgugauccaggacggcagcagcgcccacagaaacgagccccagcagugggugcugcccgacuacagcggcagaaccgugcacaacgugcaccuggcccccgccguggcccccaccuuccccggcgagcagcugcccuucuucagaagcaccaugcccggcugcagcggcuaccccaacauggaccuggacugccugcugccccaggagugggugcagcacuucuaccaggaggccgcccccagccagagcgacguggcccugcugagauucgugaaccccgacaccggcagagugcuguucgagugcaagcugcacaaggccggcuacgugaccguggcccacaccggccagcacgaccuggugaucccccccaacggcuacuucagauucgacagcugggugaaccagagcuacacccuggcccccaugggcaacggcgccggcagaagaagauga

SEQ ID NO: 25774 - RNA, 1617 nt, Artificial Sequence
  derived and/or modified sequence opt4 from VP1__Norovirus_and/or_Norovirus-like__KX514368
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccggcaacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25775 - RNA, 1617 nt, Artificial Sequence
  derived and/or modified sequence opt4 from VP1__Norovirus_and/or_Norovirus-like__KX514351
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccggccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugaaccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcaaccugguggugcagccccagaacggcagaugcaugaucgacggcgugcugcugggcaccacccagcugagccccgugaacaucugcaccuucagaggcgacgugacccaccugagagacagcaccaucuacaccaugaaccuggccagccccaacuggaacaacuacgaccccaccgaggagauccccgccccccugggcacccccgacuucgugggcaagauccagggcgugcugacccagaccaccaagggcgagggcagcaccagaggccacagagccaccguguacgugggcagcgccaacuacacccccaagcugggcaaggugcaguucgagaccaacaccaccaacgaccuguacgcccaccagaacaccaaguucacccccgugggcguggugcagggcggcgagagcgcccacagaagcgagccccagcagugggugcugcccggcuucagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25776 - RNA, 1617 nt, Artificial Sequence
  derived and/or modified sequence opt4 from VP1__Norovirus_and/or_Norovirus-like__KC517372
augaagauggccagcaacgacgccaaccccagcgacggcagcgccgugaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgccagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacguggcccacaucgccggcagcagaaacuacaccaugaaccuggccagccugaacuggaacaacuacgaccccaccgaggagauccccgccccccugggcacccccgacuucgugggcaagauccagggcaugcugacccagaccaccaagggcgacggcagcaccagaggccacaaggccaccguguacaccggcagcgcccccuucacccccaagcugggcagcgugcaguucgagaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcugcuguucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccagcggcuacuucagauucgacagcugggugaaccaguucuacacccuggcccccaugggcaacggcaccggcagaagaagauga

SEQ ID NO: 25777 - RNA, 1617 nt, Artificial Sequence
  derived and/or modified sequence opt4 from VP1__Norovirus_and/or_Norovirus-like__JN400613
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucagaggcagaagcagcgcccugguggugcacccccagaacggcagaugcaccaccgacggcgugcugcugggcaccacccagcugagccccgugaacaucugcaccuucagaggcgacgugacccacaucgccggcagccacaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcagcaccacccacagaaacgagccccagcagugggugcugcccagcuacagcggcggcaacgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgaguacaagcugcacaagagcgacuacgugaccguggcccacaccggccagcacgaccuggugaucccccccaacggcuacuucagauucgacagcugggugaaccaguucuacacccuggccgccaugggcaacggcaccggcagaagaagauga

SEQ ID NO: 25778 - RNA, 1617 nt, Artificial Sequence
  derived and/or modified sequence opt4 from VP1__Norovirus_and/or_Norovirus-like__KX514291
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucaccggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcgugauccagggcggcgagagcgcccacagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25779 - RNA, 1617 nt, Artificial Sequence
  derived and/or modified sequence opt4 from VP1__Norovirus_and/or_Norovirus-like__KX514219
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25780 - RNA, 1617 nt, Artificial Sequence
  derived and/or modified sequence opt4 from VP1__Norovirus_and/or_Norovirus-like__AB933668
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccguggugaagaccacccugagcgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccugaacuggaacaacuacgaccccaccgaggagauccccgccccccugggcacccccgacuucgugggcaagauccagggcgugcugacccagaccaccaagggcgacggcagcaccagaggccacaaggccaccguguacaccggcagcgcccccuucacccccaagcugggcagcgugcaguucagcaccgacaccgagaacgacuucgagacccaccagaacaccaaguucacccccgugggcgugauccaggacggcggcaccacccacagaaacgagccccagcagugggugcugcccagcuacagcggcagaaacgugcccaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25781 - RNA, 1617 nt, Artificial Sequence
  derived and/or modified sequence opt4 from VP1__Norovirus_and/or_Norovirus-like__KJ678149
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgaccugaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcaccauccccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25782 - RNA, 1617 nt, Artificial Sequence
  derived and/or modified sequence opt4 from VP1__Norovirus_and/or_Norovirus-like__KP244318
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucagaaccuucagaggcgacgugacccacauccccggcagcagaaacuacaccaugaacagcgccagccagaacuggaacagcuacgaccccaccgaggagauccccgccccccugggcacccccgacuucgugggcaagauccagggcgugcugacccagaccaccagagccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25783 - RNA, 1617 nt, Artificial Sequence
  derived and/or modified sequence opt4 from VP1__Norovirus_and/or_Norovirus-like__KX514362
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccggcggcagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25784 - RNA, 1617 nt, Artificial Sequence
  derived and/or modified sequence opt4 from VP1__Norovirus_and/or_Norovirus-like__KX514329
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccacagcggcaacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25785 - RNA, 1617 nt, Artificial Sequence
  derived and/or modified sequence opt4 from VP1__Norovirus_and/or_Norovirus-like__KJ678152
augaagauggccagcagcgacgccaaccccugcgacggcagcgccgccaaccuggugcccgaggugaacaacgaggugauggcccuggagcccguggugggcgccgccaucgccgcccccgugggcggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaccccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggagcaacuacgaccccaccgaggagauccccgccccccugggcacccccgacuucgugggcaagauccagggcgugcugacccagaccaccagaaccgacggcagcaccagaggccacaaggccaccguguacaucggcagcgccgacuucgcccccaagcugggcagagugcaguucgagaccgacaccgaccacgacuucgagaccaaccagaacaccaaguucacccccgugggcgugauccaggacggcagcaccacccacagaaacgagccccagcagugggugcugcccagcuacagcggcagaaacacccccaacgugcaccuggcccccgccguggcccccaccuuccccggcgagcagcugcuguucuucagaagcacccugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25786 - RNA, 1617 nt, Artificial Sequence
  derived and/or modified sequence opt4 from VP1__Norovirus_and/or_Norovirus-like__KX514352
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuguacgcccaccagaacaccaaguucacccccgugggcguggugcagggcggcgagagcgcccacagaagcgagccccagcagugggugcugcccggcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25787 - RNA, 1617 nt, Artificial Sequence
  derived and/or modified sequence opt4 from VP1__Norovirus_and/or_Norovirus-like__KX514339
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccagagcggcaacaccaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25788 - RNA, 1617 nt, Artificial Sequence
  derived and/or modified sequence opt4 from VP1__Norovirus_and/or_Norovirus-like__KR904238
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcccuucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccuacggcuacuucagauucgacagcugggugaaccaguucuacacccuggcccccaugggcaacggcaccggcagaagaagauga

SEQ ID NO: 25789 - RNA, 1617 nt, Artificial Sequence
  derived and/or modified sequence opt4 from VP1__Norovirus_and/or_Norovirus-like__KJ710245
augaagauggccagcagcgacgccaaccccagcgacggcagcaccgccaaccuggugcccgaggugaacgacgaggugauggcccuggagcccguggugggcgccgcccuggccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgccagaaacaacuucuaccacuacaaccagagcaacgagagcaccaucaagcugaucgccaugcuguacaccccccugagagccaacaacgccggcgacgacguguucaccgugagcugcagagugcugaccagacccagccuggacuucgacuucaucuuccuggugccccccaccguggagagcagaaccaagcccuucagcgugcccauccugaccguggaggagaugaccaacagcagauuccccaucccccuggagagacuguucaccggccccagcagcgccuucgccgugcagccccagaacggcagaugcaccaccgacggcgugcugcugggcaccacccagcugagccccgugaacaucugcaccuucagaggcgacgugacccacaccaccggcagccacaacuacaccaugaaccuggccagccagaacagaagcaacuacgaccccaccgaggagauccccgccccccugggcacccccgacuucgugggcaagauccagggcgcccugacccagaccaccagagccgacggcagcaccagaggccacaaggccaccguguacaccggcagcgccgacuucacccccaagcugggcagagugcaguucgccaccgacaccgaccacgacuucgacaccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggaguggguggcccacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25790 - RNA, 1617 nt, Artificial Sequence
  derived and/or modified sequence opt4 from VP1__Norovirus_and/or_Norovirus-like__KX514298
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcgugauccagggcggcgagagcgcccacagaagcgagccccagcagugggugcugcccagcuacagcggcagagacauccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25791 - RNA, 1617 nt, Artificial Sequence
  derived and/or modified sequence opt4 from VP1__Norovirus_and/or_Norovirus-like__KX514269
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucaccggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25792 - RNA, 1617 nt, Artificial Sequence
  derived and/or modified sequence opt4 from VP1__Norovirus_and/or_Norovirus-like__KX514179
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25793 - RNA, 1617 nt, Artificial Sequence
  derived and/or modified sequence opt4 from VP1__Norovirus_and/or_Norovirus-like__KX514289
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25794 - RNA, 1617 nt, Artificial Sequence
  derived and/or modified sequence opt4 from VP1__Norovirus_and/or_Norovirus-like__KX514288
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagagcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25795 - RNA, 1617 nt, Artificial Sequence
  derived and/or modified sequence opt4 from VP1__Norovirus_and/or_Norovirus-like__KX514268
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccacggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25796 - RNA, 1617 nt, Artificial Sequence
  derived and/or modified sequence opt4 from VP1__Norovirus_and/or_Norovirus-like__JX459653
augaagauggccagcagcgaccccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaagcugaagcugagacccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25797 - RNA, 1617 nt, Artificial Sequence
  derived and/or modified sequence opt4 from VP1__Norovirus_and/or_Norovirus-like__KX514359
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25798 - RNA, 1617 nt, Artificial Sequence
  derived and/or modified sequence opt4 from VP1__Norovirus_and/or_Norovirus-like__KX514296
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccggcaccaccaacgaccuggacgcccaccagaacaccaaguucacccccgugggcguggugcagggcggcgagagcccccagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25799 - RNA, 1617 nt, Artificial Sequence
  derived and/or modified sequence opt4 from VP1__Norovirus_and/or_Norovirus-like__KX514284
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25800 - RNA, 1617 nt, Artificial Sequence
  derived and/or modified sequence opt4 from VP1__Norovirus_and/or_Norovirus-like__KX514245
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccgugacccacaccggccagcacgaccuggugaucccccccaacggcuacuucagauucgacagcugggugaaccaguucuacacccuggcccccaugggcaacggcaccggcagaaagagauga

SEQ ID NO: 25801 - RNA, 1617 nt, Artificial Sequence
  derived and/or modified sequence opt4 from VP1__Norovirus_and/or_Norovirus-like__KX514327
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccacagcggcaacagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25802 - RNA, 1617 nt, Artificial Sequence
  derived and/or modified sequence opt4 from VP1__Norovirus_and/or_Norovirus-like__KX514301
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25803 - RNA, 1617 nt, Artificial Sequence
  derived and/or modified sequence opt4 from VP1__Norovirus_and/or_Norovirus-like__KX514299
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25804 - RNA, 1617 nt, Artificial Sequence
  derived and/or modified sequence opt4 from VP1__Norovirus_and/or_Norovirus-like__KX514277
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgagcugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25805 - RNA, 1617 nt, Artificial Sequence
  derived and/or modified sequence opt4 from VP1__Norovirus_and/or_Norovirus-like__KX514213
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcaaccugguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25806 - RNA, 1617 nt, Artificial Sequence
  derived and/or modified sequence opt4 from VP1__Norovirus_and/or_Norovirus-like__KT033903
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcggcgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaaggugcagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccgugagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25807 - RNA, 1617 nt, Artificial Sequence
  derived and/or modified sequence opt4 from VP1__Norovirus_and/or_Norovirus-like__HM625866
augaagauggccagcagcgacgccaaccccagcgacggcagcaccgccaaccuggugcccgaggugaacaacgaggugauggcccuggagcccguggugggcgccgccagcgccgcccccguggccggccagcagaacgugaucgaccccuggaucagaaacaacuucgugcaggcccccggcggcgaguucaccgagagccccaccaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugcccgccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgcccccgugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacauccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25808 - RNA, 1617 nt, Artificial Sequence
  derived and/or modified sequence opt4 from VP1__Norovirus_and/or_Norovirus-like__KX514319
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccggcggcagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25809 - RNA, 1617 nt, Artificial Sequence
  derived and/or modified sequence opt4 from VP1__Norovirus_and/or_Norovirus-like__KX514311
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaugaucgacggcgugcugcugggcaccacccagcugagccccgugaacaucugcaccuucagaggcgacgugacccaccccggcggcagcaagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccgacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25810 - RNA, 1617 nt, Artificial Sequence
  derived and/or modified sequence opt4 from VP1__Norovirus_and/or_Norovirus-like__KX514266
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccggcgacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25811 - RNA, 1617 nt, Artificial Sequence
  derived and/or modified sequence opt4 from VP1__Norovirus_and/or_Norovirus-like__KX514235
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25812 - RNA, 1617 nt, Artificial Sequence
  derived and/or modified sequence opt4 from VP1__Norovirus_and/or_Norovirus-like__KX354115
augaagauggccagcagcgacgccaaccccagcgacggcagcgccgccaaccuggugcccgaggccaacaacgaggugauggcccuggagcccguggccggcgccgcccuggccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccagcggccugagccccagccaggugaccauguuccccagcguggugguggacgugagacagcuggagcccgugcugaucccccugcccgacgugagaaacaacuucuaccacuacaaccagagcaacgaccccaccaucacccugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacaucauccacaucaccggcagccacaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgccgacuucauccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25813 - RNA, 1617 nt, Artificial Sequence
  derived and/or modified sequence opt4 from VP1__Norovirus_and/or_Norovirus-like__KM272334
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaaccuacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucgugguggacgccagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacagcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgugccccugggcacccccgacuucgugggcaagauccagggcgugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcggcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccagggcgccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25814 - RNA, 1617 nt, Artificial Sequence
  derived and/or modified sequence opt4 from VP1__Norovirus_and/or_Norovirus-like__KX354116
augaagauggccagcagcgacgccaaccccagcgacggcagcgccgccaaccuggugcccgaggccaacaacgaggugauggcccuggagcccguggccggcgccgcccuggccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgccggccugagccccagccaggugaccauguuccccagcguggugguggacgugagacagcuggagcccgugcugaucccccugcccgacgugagaaacaacuucuaccacuacaaccagagcaacgaccccaccaucacccugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacaucauccacaucaccggcagccacaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgccgacuucauccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25815 - RNA, 1617 nt, Artificial Sequence
  derived and/or modified sequence opt4 from VP1__Norovirus_and/or_Norovirus-like__KX514172
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccagaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25816 - RNA, 1617 nt, Artificial Sequence
  derived and/or modified sequence opt4 from VP1__Norovirus_and/or_Norovirus-like__KX354114
augaagauggccagcagcgacgccaaccccagcgacggcagcgccgccaaccuggugcccgaggccaacaacgaggugauggcccuggagcccguggccggcgccgcccuggccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccagcggccugagccccagccaggugaccauguuccccagcguggugguggacgugagacagcuggagcccgugcugaucccccugcccgacgugagaaacaacuucuaccacuacaaccagagcaacgaccccaccaucacccugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacaucauccacaucaccggcagccacaacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccguguacaccggcagcgccgacuucauccccaagcugggcagagugcaguucgagaccgacaccaaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaaagagauga

SEQ ID NO: 25817 - RNA, 1617 nt, Artificial Sequence
  derived and/or modified sequence opt4 from VP1__Norovirus_and/or_Norovirus-like__KX514295
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugaaccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25818 - RNA, 1617 nt, Artificial Sequence
  derived and/or modified sequence opt4 from VP1__Norovirus_and/or_Norovirus-like__KX514242
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25819 - RNA, 1617 nt, Artificial Sequence
  derived and/or modified sequence opt4 from VP1__Norovirus_and/or_Norovirus-like__KX514224
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacguguucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25820 - RNA, 1617 nt, Artificial Sequence
  derived and/or modified sequence opt4 from VP1__Norovirus_and/or_Norovirus-like__KX514262
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcgccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25821 - RNA, 1617 nt, Artificial Sequence
  derived and/or modified sequence opt4 from VP1__Norovirus_and/or_Norovirus-like__KX354139
augaagauggccagcagcgacgccaaccccagcgacggcagcgccgccaaccuggugcccgaggccaacaacgaggugauggcccuggagcccguggccggcgccgcccuggccgcccccguggccggccagcagaacgugaucgaccccuggaucagaaacaacuucgugcaggcccccggcggcgaguucaccaucagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccaccggccugagccccagccaggugaccauguuccccagcguggugguggacgugagacagcuggagcccgugaugaucccccugcccgacgugagaaacaacuucuaccacuacaaccagagcaacgaccccaccaucacccugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagagacuguucaccggccccagcagcgccuucguggugcagccccagaacggcagaugcaccaccgacggcgugcugcugggcaccacccagcugagccccgugaacaucugcaccuucagaggcgacgugacccacaucaccggcagcagaaacuacaccaugaaccuggccagccagaacuggaacaacuacgaccccaccgaggagauccccgccccccugggcacccccgacuucgugggcaagauccagggcaugcugacccagaccaccagaaccgacggcagcaccagaggccacaaggccaccguguacaccggcagcgccgacuucgcccccaagcugggcagagugcaguucgagaccgacaccgaccacgacuucgaggccaaccagaacaccaaguucacccccgugggcgugauccaggacggcagcaccacccacagaaacgagccccagcagugggugcugcccagcuacagcggcagaaacacccacaacgugcaccuggcccccgccguggcccccaccuuccccggcgagcaggugaucuucaucagaagcaccaugcccggcagcagcggcuaccccaacauggaccuggacugccugcugccccaggagugggugcaguacuucuaccaggaggccgcccccgcccagagcgacguggccaugaucagauucgugaaccccgacaccggcagagugcuguucgagugcaagcugcacaagagcggcuacaucaccguggcccacaccggccagcacgaccuggugaucccccccaacggcuacuucagauucgacagcugggugaaccaguucuacacccuggcccccaugggcaacggcaccggcagaagaagauga

SEQ ID NO: 25822 - RNA, 1617 nt, Artificial Sequence
  derived and/or modified sequence opt4 from VP1__Norovirus_and/or_Norovirus-like__KX514215
augaagauggccagcaacgacgugaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccggccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugaaccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccgugcaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccaacuacgcccccaagcugggcagagugcaguucgagaccgacaccaccaacgaccuggacgcccaccagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25823 - RNA, 1617 nt, Artificial Sequence
  derived and/or modified sequence opt4 from VP1__Norovirus_and/or_Norovirus-like__KX514367
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaccuucguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacaacuacgaccccaccgaggagauccccgccccccugggcacccccgacuucgugggcaagauccagggcaugcugacccagaccaccaagggcgagggcagcaccagaggccacagagccaccguguacgugggcagcgccgacuacgcccccaagcugggcagagugcaguucgagaccgacaccaccaacgaccuggacgcccaccagaacaccaaguucacccccgugggcguggugcagggcggcgagagccccaagggcagcgagccccagcagugggugcugcccagccacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25824 - RNA, 1617 nt, Artificial Sequence
  derived and/or modified sequence opt4 from VP1__Norovirus_and/or_Norovirus-like__KX514243
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgccacccuggacaagcuguucaccggccccagcagcaaccugguggugcagccccagaacggcagaugcaugaucgacggcgugcugcugggcaccacccagcugagccccgugaacaucugcaccuucagaggcgacgugacccaccccagagacagccccaucuacaccaugaaccuggccagccccaacuggaacagcuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugcaguucaagaccgagaccgaccacgaccugagcaucagacagaacaccaaguucacccccgugggcguggugcagggcggcgagagcccccagagaagcgagccccagcagugggugcugcccagcuacagcggcagagacacccccaacgugcaccuggcccccgccguggcccccaccuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25825 - RNA, 1617 nt, Artificial Sequence
  derived and/or modified sequence opt4 from VP1__Norovirus_and/or_Norovirus-like__KX353996
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccgugcugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcagcagaaacuacaccaugaaccuggccagccagaacuggaacagcuacgaccccaccgaggagauccccgccccccugggcacccccgacuucgugggcaagauccagggcgugcugacccagaccaccagaaccaacggcagcaccagaggccacaaggccaccguguacaccggcagcgccgacuucagccccaagcugggcagagugcaguucgccaccgacaccgacaacgacuucgagaccaaccagaacaccaaguucacccccgugggcgugauccaggacggcagcaccacccccagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacagacugcccccccaggagagagugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25826 - RNA, 1617 nt, Artificial Sequence
  derived and/or modified sequence opt4 from VP1__Norovirus_and/or_Norovirus-like__DQ078820
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcuggacgugagaaacaaccuguaccacuacaaccagagcaacgaccccaccaucaagcugaucgccaugcuguacaccccccugagagccaacaacgccggcgaggugguguucaccgugagcugcagagugcugaccagacccagccccgacuucgacuucaucuuccuggugccccccaccguggagagcagaaccaagcccuucaccgugcccauccugaccgccgaggagaugaccaacagcagauuccccaccccccugggcaagcuguucaccggccccagcagcgccuucguggugcagccccagaacggcagaugcgccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagaggccacaaggccaccgugagcaccggcagcgugcacuucacccccaagcugggcggcgugcaguucaccaccgacaccaacaacgacuucgagaccggccagaacaccaaguucacccccgugggcgugauccaggacggcaacagcacccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacgccggcagagugcuguucgagugcaagccccacaagagcggcuacgugaccguggcccacaccggccagcacgaccuggugaucccccccaacggcuacuucagauucgacagcugggugaaccaguucugcacccuggcccccaugggcaacggcaccggcagaagaagauga

SEQ ID NO: 25827 - RNA, 1617 nt, Artificial Sequence
  derived and/or modified sequence opt4 from VP1__Norovirus_and/or_Norovirus-like__AB933738
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccuguucccccuggccagaaaggugaagggcuacgccggcggcuucgaggugcaggugauccuggccggcaaggccuuccccgccggcaagaucaucuucgccgccagcccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcaccuucguggugcagccccagaacggcagaugcaccaccgacggcgugcugcugggcaccacccagcugagccccgugaacaucugcaccuucagaggcgacgugacccacaucgccggcagcagaaacuacaccaugaaccuggccagccagaacuggaacagcuacgaccccaccgaggagauccccgccccccugggcacccccgacuucgugggcaagauccagggcgugcugacccagaccaccagaagagacggcagcaccagaggccacaaggccaccguguacaccggcagcgccgacuucagccccaagcugggcagagugcaguucgccaccgacaccgacaacgacuucgacacccaccagaacaccaaguucacccccgugggcgugauccaggacggcggcaccgcccacagaaacgagccccagcagugggugcugcccagcuacagcggcagaaacacccacaacgugcaccuggcccccgccguggcccccaccuuccccggcgagcagcugcuguucuucagaagcaccaugcccggcugcagcggcuaccccaacauggaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25828 - RNA, 1617 nt, Artificial Sequence
  derived and/or modified sequence opt4 from VP1__Norovirus_and/or_Norovirus-like__EU780734
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucgccggcacccagaacuacaccaugaaccuggccagccagaacuggaacaacuacgaccccaccgaggagauccccgccccccugggcacccccgacuucgugggcaagauccagggcgugcugacccagaccaccagaagagacggcagcaccagaggccacaaggccaccgugagcaccggcagcauccacuucacccagagcugggccguguucaacagcccccugauccaggccaugacccugaagcuggccaagaccagagacagcccccagagcgugguggugcaggacggcagcaccacccaccagaacgagccccagcagugggugcugcccgacuacagcggcagagacagcuacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggagagcgcccccgcccagagcgacguggcccugcugagauucgugaaccccgacaccggcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25829 - RNA, 1617 nt, Artificial Sequence
  derived and/or modified sequence opt4 from VP1__Norovirus_and/or_Norovirus-like__KP064096
auggccagcaaggacgcccccaccaacauggacggcaccagcggcgccggccagcuggugcccgaggccaacaccgccgagcccaucagcauggagcccguggccggcgccgugaccgccgccgccaccgccggccaggugaacaugaucgaccccuggaucaugaacaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcaucccccccggcuucguggcccagaacaucagcaucgcccaggccaccauguucccccacgugaucgccgacgugagagugcuggagcccaucgaggugccccuggaggacgugagaaacgugcuguuccacaacaacgacaacacccccaccaugagacuggugugcauccuguacaccccccugagagccagcggcagcagcagcggcaccgaccccuucgugaucgccggcagagugcugaccugccccagccccgacuucagcuuccuguuccuggugccccccaacguggagcagaagaccaagcccuucagcgugcccaaccugccccugaacacccugagcaacagcagagugcccagccugaucaagagcaugauggugagcagagaccacggccagauggugcaguuccagaacggcagagugacccuggacggccagcugcagggcaccacccccaccagcgccagccagcugugcaagaucagaggcagcguguuccacgccaacggcggcaacggcuacaaccugaccgagcuggacggcagccccuaccacgccuucgagagccccgcccccaucggcuuccccgaccugggcgagugcgacuggcacauggaggccagccccaccacccaguucaacaccggcgacgugaucaagcagaucaacgugaagcaggagagcgccuucgccccccaccugggcaccauccaggccgacggccugagcgacgugagcgugaacaccaacaugaucgccaagcugggcugggugagccccgugagcgacggccacaagagagacguggaccccugggugauccccagauacggcagcacccugaccgaggccgcccagcuggccccccccaucuacccccccggcuucggcgaggccaucguguucuucaugagcgacuuccccaucgcccacggcaccaacggccugagcgugcccugcaccaucccccaggaguucgugacccacuucgugaacgagcaggcccccaccagaggcgaggccgcccugcugcacuaccuggaccccgacacccacagaaaccugggcgaguucaagcuguaccccgacggcuucaugaccugcgugcccaacaccagcggcaccggcccccagacccugcccaucaacggcguguucguguucgugagcugggugagcagauucuaccagcugaagcccgugggcaccgccggccccgccagaagacuguga

SEQ ID NO: 25830 - RNA, 1617 nt, Artificial Sequence
  derived and/or modified sequence opt4 from VP1__Norovirus_and/or_Norovirus-like__KC473548
augaugauggccagcaaggacgcccccaccaacauggacggcaccagcggcgccggccagcuggugcccgaggccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcaccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugagcaugcugaucgacggcaugauggugagcaacgaccagaaccaggugccccaguuccagaacggcagagugacccuggacggccagcugcagggcaccaccaccgugagcgccgccugcguggccagaaugagaggcagaaucuucaacaacaacggcaacuacggcgugaaccugaccgagcuggacggcaaccccuaccacgccuucgacagccccgccccccugggcuuccccgacuucggcaacugcgaccugcacaugaccuucgugaagaucaaccccaacgagcugagcagcggcgaccccagcggcaagguggugaucagaagcuacgacgccaccuucgccccccaccugggcaccgugaagcuggagaacgacgacgagcuggccagauucgugggcaaggagguggugcuggagcugaccugggugagcaacagagagggcgccacccugaaccugugggccgugcccaacuacggcagcagccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacuguga

SEQ ID NO: 25831 - RNA, 1617 nt, Artificial Sequence
  derived and/or modified sequence opt4 from VP1__Norovirus_and/or_Norovirus-like__AB684698
auggccagcaaggacgcccccagcaacauggacggcaccagcggcgccggccagcuggugcccgaggccaacaccgccgagcccaucaacauggagagcguggugggcgccgccaccgccaccgccaccgccggccaggugaaccugaucgaccccuggaucaugaacaacuacgugcaggccccccagggcgaguucaccaucagccccaacaacacccccggcgacgugcuguucgaccugcagcugggcccccaccugaaccccuuccugagccaccugagcagaauguacaacggcugggugggcaacaugaaggugagagugaugcuggccggcaacgccuucagcgccggcaagaucaucaucugcugcaucccccccggcuucaccagccagagcaucagcaucgcccaggccaccauguucccccacgugaucgccgacgugagagugcuggagcccaucgacgugccccuggacgacgugagaaacgugcuguuccacaacaacgacaacgcccagaccaugagacugcugugcaugcuguacaccccccugagaaccggcgccagcagcagcggcagcgaccccuucgugaucgccggcagagugcugaccugccccacccaggacuucaacuuccuguuccuggugccccccgacguggagcagaagaccaagcccuucagcgugcccaacaucccccugaaccugaugagcaacagcagagugcccgcccugaucgacggcaugaccgugagcagcgaccagaaccagguggugcaguuccagaacggcagagugacccuggacggccagcugcagggcaccaccgccgugagcgccagcugcguggccaagaucagaggcagaaucuucagcaacgccagccacuacggcaucaaccugaccgagguggacggcacccaguaccacgccuucgacagccccgccccccugggcuuccccgacuucggcaacugcgacuggcacgugaccggcaccaaggccagccagggcgaccugcagaccgacaaccccaccaucagcggcaccaucaagagcuacgagagcagcuucgccccccaccugggcaccgugagaaucgagggcgacgacaacgagcuggccagauucaacggcaaggacgugcugcugaaccugaccugguucagccagagaaacggcagccagcugaaccuguggaccauccccagcuacggcagcaaccugaccgaggccagccagcuggccccccccaucuacccccccggcuucggcgaggccaucguguacuucaccagcaccuuccccgccaucagcagacccagcgugcccugcaccaugccccaggaguucgugagccacuucgugaacgagcaggcccccaccagaggcgaggccgcccugcugcacuaccuggaccccgacacccacagaaaccugggcgaguucaagauguaccccgagggcuucuucaccugcgugcccaacgccggcggcagcggcccccagacccugcccaucaacggcguguucguguucgugagcugggugagcagauacuaccagcugaagcccgugggcaccgugggcaugaccagaagacuguga

SEQ ID NO: 25832 - RNA, 1617 nt, Artificial Sequence
  derived and/or modified sequence opt4 from VP1__Norovirus_and/or_Norovirus-like__AF538679
augaagauggccagcaaggacgcccccaccaacauggacggcaccagcggcgccggccagcuggugcccggcgccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcgccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugcccaugcugaucgacggcaugauggugagcaacgaccagaaccaggugccccaguuccagaacggcagagugacccuggacggccagcugcagggcaccaccaccgugagcgccgccugcaucgccagaaugagaggcagaaucuucaacaacaacggcaacuacggcgugaaccuggccgagcuggacggcaaccccuaccacgccuucgacagccccgccccccugggcuuccccgacuucggcaacugcgaccugcacaugaccuucgugaagaucaaccccaccgagcugagcaccggcgaccccagcggcaagguggugauccacagcuacgacgccaccuucgccccccaccugggcaccgugaagcuggaggacaacaacgagcuggaccaguucgugggcaaggagguggugcuggagcugaccugggugagcaacagaaccggcgccacccugaaccugugggccgugcccaacuacggcagcaaccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacuguga

SEQ ID NO: 25833 - RNA, 1617 nt, Artificial Sequence
  derived and/or modified sequence opt4 from VP1__Norovirus_and/or_Norovirus-like__JQ743332
augaugauggccagcaaggacgccagccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25834 - RNA, 1617 nt, Artificial Sequence
  derived and/or modified sequence opt4 from VP1__Norovirus_and/or_Norovirus-like__GQ856470
augaugauggccagcaaggacgcccccaccaacauggacggcaccagcggcgccggccagcuggugcccgaggugagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccgaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggugcaggaccccaccuucgccccccaccugggcaccauccacuacaccaacgccaacuacgacgccaacgugagccugaucugcagccuggaguggcugagcccccccagcggcggcgcccugaaggccaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacuguga

SEQ ID NO: 25835 - RNA, 1617 nt, Artificial Sequence
  derived and/or modified sequence opt4 from VP1__Norovirus_and/or_Norovirus-like__JN603244
augaugauggccagcaaggacgcccccaccaacauggacggcaccagcggcgccggccagcuggugcccgaggugagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccaaccugccccugaacgugcugagcaacagcagagugcccagccugaucaagagcaugauggugagccaggaccacggccagauggugcaguuccagaacggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggcccaggacagcaccuucgccccccaccugggcaccauccacuacaccaacgccgacuacaacgccaacgugggccugaucugcagccuggaguggcugagcccccccagcggcggcgcccccaaggugaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacuguga

SEQ ID NO: 25836 - RNA, 1617 nt, Artificial Sequence
  derived and/or modified sequence opt4 from VP1__Norovirus_and/or_Norovirus-like__AB078335
augaugauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25837 - RNA, 1617 nt, Artificial Sequence
  derived and/or modified sequence opt4 from VP1__Norovirus_and/or_Norovirus-like__GU299761
augaugauggccagcaaggacgcccccaccaacauggacggcaccagcggcgccggccagcuggugcccgaggccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcaccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugagcaugcugaucgacggcaugauggugagcaacgaccagaaccaggugccccaguuccagaacggcagagugacccuggacggccagcugcagggcaccaccaccgugagcgccgccugcguggccagaaugagaggcagaaucuucaacaacaacggcaacuacggcgugaaccugaccgagcuggacggcaaccccuaccacgccuucgacagccccgccccccugggcuuccccgacuucggcaacugcgaccugcacaugaccuucgugaagaucaaccccaacgagcugagcagcggcgaccccagcggcaagguggugauccacagcuacgacgccaccuucgccccccaccugggcaccgugaagcuggagaacgacgacgagcuggccagauucgugggcaaggagguggugcuggagcugaccugggugagcaacagagagggcgccacccugaaccugugggccgugcccaacuacggcagcagccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacuguga

SEQ ID NO: 25838 - RNA, 1617 nt, Artificial Sequence
  derived and/or modified sequence opt4 from VP1__Norovirus_and/or_Norovirus-like__AJ277610
augaugauggccagcaagggcgccccccagagcgccgacggcagcagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacagccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagagugagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccugggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25839 - RNA, 1617 nt, Artificial Sequence
  derived and/or modified sequence opt4 from VP1__Norovirus_and/or_Norovirus-like__GQ856462
augaugauggccagcaaggacgcccccaccaacauggacggcaccagcggcgccggccagcuggugcccgaggccaacaccgccgagccccugcccaucaagcccguggccggcgccgccaccgccguggccaccgccggccaggugaacaugaucgaccccuggaucaugaacaacuucgugcaggccccccagggcgaguucaccaucagccccaacaacacccccggcgacauccuguucgaccugcagcugggcccccaccugaaccccuuccuggcccaccugagcagaauguacaacggcugggugggcaacaugcaggugagaaucaugcuggccggcaacgccuucagcgccggcaagaucaucgugugcugcaucccccccggcuucagcagccagagcaucagcaucgcccaggccaccauguucccccacgugaucgccgacgugagagugcuggagcccaucgacgugccccuggacgacgugagaaacgugcuguuccacaacaacgacaacccccagaccaugagacugcugugcaugcuguacaccccccugagaagcggcggcaccagcagcggcaccgaccccuucgugaucgccggcagagugcugaccugccccacccccgacuucagcuuccuguuccuggugccccccgacaucgagcagagaaccaagcccuucagcgugcccaacauccccaugaaccugaugagcaacagcagagugagcaugcugaucgacggcaugauggugagcaacgaccagaaccaggugccccaguuccagaacggcagagugacccuggacggccagcugcaggacaccaccaccgugagcgccgccugcguggccagaaugagaggcagaaucuucaacaacaacggcaacuacggcgugaaccugaccgagcuggacggcaaccccuaccacgccuucgacagccccgccccccugggcuuccccgacuucggcaacugcgaccugcacaugaccuucgugaagaucaaccccaacgagcugagcagcggcgaccccagcggcaagguggugauccacagcuacgacgccaccuucgccccccaccugggcaccgugaagcuggagaacgacgacgagcuggccagauucgugggcaaggagguggugcuggagcugaccugggugagcaacagagagggcgccacccugaaccugugggccgugcccaacuacggcagcagccugacccaggccagccagcuggccccccccaucuacccccccggcuucggcgaggccaucguguacuucaccagcaccuuccccaccgugagcaaccccaaggugcccugcacccugccccaggaguucgugagccacuucgugaacgagcaggcccccaccagaggcgacgccgcccugcugcacuacguggaccccgacacccacagaaaccugggcgaguucaagauguaccccgagggcuacaugaccugcgugcccaacgccggcggcggcccccagacccugcccaucaacggcguguucguguucaucagcugggugagcagauacuaccagcugaagcccgugggcaccgccggcgccgccagaagacuguga

SEQ ID NO: 25840 - RNA, 1617 nt, Artificial Sequence
  derived and/or modified sequence opt4 from VP1__Norovirus_and/or_Norovirus-like__AF435807
augaagauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaccgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcgacagcgacagcuucgugguggccggcaaggugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25841 - RNA, 1617 nt, Artificial Sequence
  derived and/or modified sequence opt4 from VP1__Norovirus_and/or_Norovirus-like__KX396056
augaugauggccagcaaggacgcccccaccaacauggacggcaccagcggcgccggccagcuggugcccgaggccagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccaaccugccccugaacgugcugagcaacagcagagugcccagccugaucagaagcaugauggugagccaggaccacggccagauggugcaguuccagaacggcagagugacccuggacggccagcugcagggcaccacccccaccagcgccagccagcugugcaagaucagaggcaccguguaccacgccaccggcggccagggccugaaccugaccgagaucgacggcacccccuaccacgcccuggagagccccgcccccaucggcuuccccgaccugggcgagugcgacuggcacaucaacgccagccccgccaacgccuucaccgacggcagcaucauccacagaaucgacguggcccaggacagcaccuucgccccccaccugggcaccauccacuacaccaacgccaacuacgacgccaacaucagccugaucugcagccuggaguggcugagcccccccagcggcggcgcccccaaggugaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacuguga

SEQ ID NO: 25842 - RNA, 1617 nt, Artificial Sequence
  derived and/or modified sequence opt4 from VP1__Norovirus_and/or_Norovirus-like__AB187514
augaugauggccagcaaggacgcccccaccaacauggacggcaccagcggcgccggccagcuggugcccgaggccagcaccgccgagcccaucagcauggagcccguggccggcgccgccaccgccgccgccaccgccggccaggugaacaugaucgaccccuggaucaugagcaacuacgugcaggccccccagggcgaguucaccaucagccccaacaacacccccggcgacauccuguucgaccugcagcugggcccccaccugaaccccuuccugagccaccuggcccagauguacaacggcugggugggcaacaugaaggugagagugcugcuggccggcaacgccuucaccgccggcaagaucaucaucagcugcgugccccccggcuucgccgcccagaacgugagcaucgcccaggccaccauguucccccacgugaucgccgacgugagagugcuggagcccaucgaggugccccuggaggacgugagaaacgugcuguuccacaacaacgacagcacccccaccaugagacugaucugcaugcuguacaccccccugagagccagcggcagcagcagcggcaccgaccccuucgugaucgccggcagagugcugaccugccccagccccgacuucaacuuccuguuccuggugccccccaacguggagcagaagaccaagcccuucagcgugcccaaccugccccugaacgugcugagcaacagcagagugcccagccugaucaagagcaugauggugagccaggaccacggccagauggugcacuuccagaucggcagagugacccuggacggccagcugcagggcaccacccccaccagcgccagccagcugugcaagaucagaggcaccguguaccacgccaccggcggccagggccugaaccugaccgagaucgacggcacccccuaccacgccuucgagagccccgcccccaucggcuuccccgaccugggcgagugcgacuggcacaucaacgccagccccgccaacgccuucaccgacggcagcaucauccacagaaucgacguggcccaggacagcaccuucgccccccaccugggcaccauccacuacaccaacgccaacuacgacgccaacgugagccugaucugcagccuggaguggcugagcccccccagcggcggcgcccccaaggugaaccccugggccauccccagauacggcagcacccugaccgaggccgcccagcuggccccccccaucuacccccccggcuucggcgaggccaucguguucuucaugagcgacuuccccaucgccaacggcagcgacggccugagcgugcccugcaccaucccccaggaguucgugacccacuucgugaacgagcaggcccccaccagaggcgaggccgcccugcugcacuacguggaccccgacacccacagaaaccugggcgaguucaagcuguaccccgagggcuucaugaccugcgugcccaacagcagcggcagcggcccccagacccugcccaucaacggcguguucaccuucaucagcugggugagcagauucuaccagcugaagcccgugggcaccaccggccccgugagaagacuguga

SEQ ID NO: 25843 - RNA, 1617 nt, Artificial Sequence
  derived and/or modified sequence opt4 from VP1__Norovirus_and/or_Norovirus-like__L07418
augaugauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccggcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25844 - RNA, 1617 nt, Artificial Sequence
  derived and/or modified sequence opt4 from VP1__Norovirus_and/or_Norovirus-like__FJ515294
augaugauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcugcgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcaacagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcguggacgugcagaccgacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacgugacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25845 - RNA, 1617 nt, Artificial Sequence
  derived and/or modified sequence opt4 from VP1__Norovirus_and/or_Norovirus-like__KJ790198
augagaauggccagcgacgacgccaagagcgcccccagcgaccuggagggcgccggccuggugcccgccaccgccgccccccugcccguggcccccguggccggcgcccaggccgccgagcccuucgccggccagaucaacgugaucgaccccuggaucuacaccaacuucgugcaggcccccaccggcgaguucaccgugagccccagaaacacccccggcgaggugcuggugaaccuggagaucggccccaaccugaaccccuaccugcagcaccuggcccagauguacaacggcuacgccggcggcguggaggugcaggugauccuggccggcaacgccuucaccgccggcaagcugcugugcgcccuggugccccccggcuuccccaccagcagcaucacccccgcccagcugaccaugcugccccacaccaucaucgacgugagaaccaccgaccccgugguggugcccaugcccgacgugagaagaacccuguggcacgaggugagaagcaccaccgagccccugaugagacuggugaucaugcuguacacccccaugagagccaacagcggcagcgacgaggccuucguggugagcggcagagugcugagcagacccgcccccgacuucaacuucuucuaccuggugccccccagaguggaggacaccguggagcccuucagccugcccgaccugagaguggacgagaugagcagcagcagauggcagaaccccguggugaugcugcaggccgaccccaaccagaacaucgccgcccacuggcagaacggcagaugcaccaucaacggcgagcugcugggcaccacccccagaaaccagagcuggcugcugagaaugagaggcagcgugcuggccgcccccggcggccagaaggccgugaccgugaacguggaccugaccgagcccgacggccaggccuucagcgugcugagcggcaaccccggccccgagggcgugcccgacuuccaggccaucuacaacgugagaaugagcaccgccagcaccaccgccggccacaccguggccaccaacggcuacaucgagcagagcggcuacacccccgcccugggcacccuggugauccagggcguggaccugagccaggugcccgcccugggcagcgaggugaccaugcagguggugagcaucgaccugaaccacaacauggaccccaccagacugcccgacuacaacggcgccggcuucgacggcagcguggcccuggcccccccccuggugcccccccugcccggcgaggugcugcugagauucaccacccugcccaucaccaccagcagaggcagcagcgugagcgccacccuggacugcgcccugcccgccgaguggaucaccugguuccuggugcacaacuucgugccccagggcgacgccgcccugcugagauacagaaacagaggcaccggccagauccuguucgagugcaagcuguacaaggagggcuuccuggccguggccggcgugagcaccagaaccguguuccccaccagcggcguguucgaguucgugagcugggugcccguguucuaccagcugacccccgugggcagcagcggcgccagaaagagauga

SEQ ID NO: 25846 - RNA, 1617 nt, Artificial Sequence
  derived and/or modified sequence opt4 from VP1__Norovirus_and/or_Norovirus-like__KF306212
augaugauggccagcaaggacgccccccagagcgccgacggcgccagcggcgccggccagcuggugcccgaggugaacaccgccgacccccugcccauggagcccguggccggccccaccaccgccguggccaccgccggccaggugaacaugaucgaccccuggaucgugaacaacuucgugcagagcccccagggcgaguucaccaucagccccaacaacacccccggcgacauccuguucgaccugcagcugggcccccaccugaaccccuuccugagccaccugagccagauguacaacggcugggugggcaacaugagagugagaauccugcuggccggcaacgccuucagcgccggcaagaucaucgugugcuucgugccccccggcuucaccagcagcagccugaccaucgcccaggccacccuguucccccacgugaucgccgacgugagaacccuggagcccaucgagaugccccuggaggacgugagaaacgugcuguaccacaccaacgacaaccagcccaccaugagacuggugugcaugcuguacaccccccugagaaccggcggcggcagcggcagcagcgacagcuucgugguggccggcagagugcugaccgcccccagcagcgacuucagcuuccuguuccuggugccccccaccaucgagcagaagaccagagccuucaccgugcccaacaucccccugcagacccugagcaacagcagauuccccagccugauccagggcaugauccugagccccgacgccagccagguggugcaguuccagaacggcagaugccugaucgacggccagcugcugggcaccacccccgccaccagcggccagcuguucagagugagaggcaagaucaaccagggcgccagaacccugaaccugaccgagguggacggcaagcccuucauggccuucgacagccccgcccccgugggcuuccccgacuucggcaagugcgacuggcacaugagaaucagcaagacccccaacaacaccagcagcggcgaccccaugagaagcgugagcgugcagaccaacgugcagggcuucgugccccaccugggcagcauccaguucgacgagguguucaaccaccccaccggcgacuacaucggcaccaucgaguggaucagccagcccagcaccccccccggcaccgacaucaaccugugggagauccccgacuacggcagcagccugagccaggccgccaaccuggccccccccguguucccccccggcuucggcgaggcccugguguacuucgugagcgccuuccccggccccaacaacagaagcgcccccaacgacgugcccugccugcugccccaggaguacaucacccacuucgugagcgagcaggcccccaccaugggcgacgccgcccugcugcacuacguggaccccgacaccaacagaaaccugggcgaguucaagcuguaccccggcggcuaccugaccugcgugcccaacggcgugggcgccggcccccagcagcugccccugaacggcguguuccuguucgugagcugggugagcagauucuaccagcugaagcccgugggcaccgccagcaccgccagauga

SEQ ID NO: 25847 - RNA, 1617 nt, Artificial Sequence
  derived and/or modified sequence opt4 from VP1__Norovirus_and/or_Norovirus-like__KM461694
augaagauggccagcaacgacgccgcccccagcaacgacggcgccgccaaccuggugcccgaggccaacaacgaggugauggcccuggagcccguggugggcgccagcaucgccgcccccguggugggccagcagaacaucaucgaccccuggaucagagagaacuucgugcaggccccccagggcgaguucaccgugagccccagaaacagccccggcgagaugcugcugaaccuggagcugggccccgagcugaaccccuaccugagccaccugagcagaauguacaacggcuacgccggcggcaugcaggugcagguggugcuggccggcaacgccuucaccgccggcaagaucaucuucgccgccgugcccccccacuuccccguggacaacaucagcgccgcccagaucaccaugugcccccacgugaucguggacgugagacagcuggagcccgugcugcugccccugcccgacaucagaaacagauucuuccacuacaaccaggaggacacccccagaaugagacugguggccaugcuguacaccccccugagagccaacagcggcgaggacguguucaccgugagcugcagagugcugaccagacccgcccccgacuucgaguucaccuuccuggugccccccaccguggagagcaagaccaagcccuucacccugcccauccugacccugggcgagcugagcaacagcagauuccccgccgccaucgacaugcuguacaccgaccccaacgagagcaucguggugcagccccagaacggcagaugcacccuggacggcacccugcagggcaccacccagcuggugcccacccagaucugcgccuucagaggcacccugaucagccagaacgccagagccgccgaccugaccgacagcccccagagagccagaaaccacccccugcacgugcaggugaagaaccuggacggcacccaguacgaccccaccgacgacauccccgccgugcugggcgccaucgacuucaagggcaccguguucggcguggccagccagagagacgugagcggcacccaggagcagggccacuacgccaccagagcccacgaggcccacaucgacaccaccgaccccaaguacgcccccaagcugggcaccauccugaucaagagcgagagcaccgacuucaccaccaaccagcccaucagauucacccccgugggcaugggcgacaacaacuggagacagugggagcugcccgacuacagcggcagccugacccugaacaugaaccuggcccccgccgugagccccagcuuccccggcgagagaauccuguucuucagaagcaucgugcccagcgccggcggcuacggcagcggcuacaucgacugccugaucccccaggagugggugcagcacuucuaccaggaggccgcccccagccagagcgccguggcccuggugagauacgugaaccccgacaccggcagaaacaucuucgaggccaagcugcacagagagggcuuccugaccguggccaacagcggcaacaaccccaucguggugccccccaacggcuacuucagauucgaggccugggugaaccaguucuacacccuggccuga

SEQ ID NO: 25848 - RNA, 1614 nt, Artificial Sequence
  derived and/or modified sequence opt4 from VP1__Norovirus_and/or_Norovirus-like__AB039780
augaagauggccagcaacgacgccgcccccagcaacgacggcgccgccggccuggugcccgagaucaaccacgaggugauggccaucgagcccguggccggcgccagccuggccgcccccguggugggccagcugaacaucaucgaccccuggaucagaaacaacuucgugcaggcccccgccggcgaguucaccgugagccccagaaacgcccccggcgaguuccugcuggaccuggagcugggccccgagcugaaccccuaccuggcccaccuggccagaauguacaacggccacgccggcggcauggaggugcagaucgugcuggccggcaacgccuucaccgccggcaagauccuguucgccgugaucccccccggcuuccccuacgagaaccugagccccgcccagcugaccaugugcccccacguggugguggacgugagacagcuggagcccauccugcugcccaugcccgacaucagaaacaccuucuuccacuacaaccagagcaacggccccaagcugagacugguggccaugcuguacaccccccugagagccaacaacgccggcgaggacguguucaccgugagcugcagagugcugaccagacccagccccgacuucgaguucaacuuccuggugccccccagcguggagagcaagaccaaggccuucacccugcccauccugaagaucagcgagaugaccaacagcagauuccccauccccguggaccagauguacaccagcagaaacgagaacaucguggugcagccccagaacggcagagugacccuggacggcgagcugcagggcaccaccacccugcagcccgugagcaucugcggcuucagaggcacccugcagaccagacuggccgaccagcccaacuacaccuaccaggugcaccuggagaaccuggacggcagccccguggaccccaccgacgaggugcccgccccccugggcacccccgacuuccaggcccagcuguucggcgugaucagccagagaagcagcgacaacgccaccagagcccacgaggccagagugaacaccaacgaccccaccuucgccccccagaucgcccaggugagauucaagagccccagcaacgacuucuucgacaacgagcccaucaaguucacccccgugggcaucagcguggacagccagaacagcuacaaccaguggcugcugcccagauacggcggccaccugaccaacaacacccaccuggcccccagcgugagccccauguuccccggcgagcagauccuguucuucagaagcuucaugcccggcgccagcggccacaccgacggcgccaucgacugccugcugccccaggaguggguggcccacuucuaccaggaggccgccaccgcccagaccgacguggcccugaucagauucgugaaccccgacaccggcagagugcuguucgagggcaagcugcacaagcagggcuucaucaccaucagcaacagcggcgaccaccccaucgugaugcccgccaacggcuacuucagauucgaggccugggugaaccaguucuacagccuggcccccgugggcaccggcagcggcagaagaagaauccaguga

SEQ ID NO: 25849 - RNA, 1614 nt, Artificial Sequence
  derived and/or modified sequence opt4 from VP1__Norovirus_and/or_Norovirus-like__AY038599
augaagauggccagcaacgacgccgcccccagcagcgacggcgccgccggcguggugcccgagaucaaccacgaggugauggccaucgagcccguggccggcgccagcaucgccgcccccguggugggccagcagaacaucaucgaccccuggaucagaaacaacuucgugcaggcccccgccggcgaguucaccgugagccccagaaacgcccccggcgaguuccugcuggaccuggagcugggccccgaccugaaccccuaccuggcccaccuggccagaauguacaacggccacgccggcggcauggaggugcagaucgugcuggccggcaacgccuucaccgccggcaagauccuguucgccgugaucccccccggcuuccccuacgagaaccugugccccgcccagcugaccaugugcccccacguggugguggacgugagacagcuggagcccgugaugcugcccaugcccgacaucagaaacaccuucuuccacuacaaccaggacggcggccccaagcugagacugaucgccaugcuguacaccccccugagagccaacaacagcggcgacgacguguucaccgugagcugcagagugcugaccagacccgcccccgacuucgaguucaccuuccuggugccccccagcaucgagagcaagaccaaggccuucaccauccccgugcugaagaucagcgagaugaccaacagcagauuccccgugcccguggaccagauguacaccagcagaagcgagggcaucguggugcagccccagaacggcagagccaccaucgacggcgagcugcugggcaccacccuggugagccccgugagcgugugcaacuucaagggcaaccugcaggccgaggugcccggccagcaccagcuguaccagcugcagcugaccaaccuggacggcagccccaucgaccccaccgacgacacccccggcccccugggcugccccgacuucaccggccugcuguacggcguggccagccagagaggccccggcgacgccaccagagcccacgaggccagaaucgacaccggcagcgacaccuucgcccccaagaucggccaggugagauucuacagcaccagcagcgacuucgagaccaaccagcccacccacuucacccccaucggcaucuacaucgagggcaacagcagcgacuucaaccaguggcagcugcccagauacggcggccaccuggccaacaacaaccaccuggcccccgccgugagcccccuguuccccggcgagcagauccuguucuucagaagcuucauccccggcgccagcggccacaccaacggcgagauggacugccugcugccccaggaguucgugcagcacuucuaccaggaggccgccaccgccagaagcgagguggcccugcugagauucgugaaccccgacaccggcagagcccuguucgagagcaagcugcacaagcagggcuucaugaccaucgccagcagcggcgaccaccccaucaucaugcccaccaacggcuacuucagauucgaggccugggugaaccaguucuacagccuggcccccgugggcaccggcagcggcagaagaagaauccaguga

SEQ ID NO: 25850 - RNA, 1614 nt, Artificial Sequence
  derived and/or modified sequence opt4 from VP1__Norovirus_and/or_Norovirus-like__AY054299
augaagauggccagcaacgacgccgcccccagcagcgacggcgccgccggccuggugcccgagaucaaccacgaggugauggccaucgagcccguggccggcgccagcaucgccgcccccguggugggccagcagaacaucaucgaccccuggaucagaaacaacuucgugcaggcccccgccggcgaguucaccgugagccccagaaacgcccccggcgaguuccugcuggaccuggagcugggccccgaccugaaccccuaccuggcccaccuggccagaauguacaacggccacgccggcggcauggaggugcagaucgugcuggccggcaacgccuucaccgccggcaagauccuguucgccgugaucccccccggcuuccccuacgagaaccugagccccgcccagcugaccaugugcccccacguggugguggacgugagacagcuggagcccgugaugcugcccaugcccgacaucagaaacaccuucuuccacuacaaccaggacggcggccccagacugagacugaucgccaugcuguacaccccccugagagccaacaacagcggcgacgacguguucaccgugagcugcagagugcugaccagacccgcccccgacuucgaguucaccuuccuggugccccccagcaucgagagcaagaccaaggccuucaccauccccgugcugaagaucagcgagaugaccaacagcagauuccccgugcccguggaccagauguacaccagcagaagcgagggcaucguggugcagccccagaacggcagagccaccaucgacggcgagcugcugggcaccacccuggugagccccgugagcgugugcaacuucaagggcaaccugcaggccgaggugcccggcgagcaccagcuguaccagcugcagcugaccaaccuggacggcagccccaucgaccccaccgacgacacccccggcccccugggcugccccgacuucaccggccugcuguacggcguggccagccagagaggccccggcgacgccaccagagcccacgaggccagaaucgacaccggcagcgacaccuacgcccccaagaucggccaggugagauucuacagcaccagcagcaacuucgagagaaaccagcccacccacuucacccccaucggcaucuacaucgagggcaacagcagcgacuucaaccaguggcagcugcccagauacggcggccaccuggccaacaacaaccaccuggcccccgccgugagcccccuguuccccggcgagcagauccuguucuucagaagcuucauccccggcgccagcggccacaccaacggcgagauggacugccugcugccccaggaguucgugcagcacuucuaccaggaggccgccaccgcccagagcgagguggcccugcugagauucgugaaccccgacaccggcagagugcuguucgagagcaagcugcacaagcagggcuucaugaccaucgccagcagcggcgaccaccccaucaucaugcccaccaacggcuacuucagauucgaggccugggugaaccaguucuacagccuggcccccgugggcaccggcagcggcagaagaagaauccaguga

SEQ ID NO: 25851 - RNA, 1614 nt, Artificial Sequence
  derived and/or modified sequence opt4 from VP1__Norovirus_and/or_Norovirus-like__AF195848
augaagauggccagcaacgacgccgcccccagcaacgacggcgccgccggccuggugcccgagaucaaccacgaggugauggccaucgagcccguggccggcgccagccuggccgcccccguggugggccagcugaacaucaucgaccccuggaucagaaacaacuucgugcaggcccccgccggcgaguucaccgugagccccagaaacgcccccggcgaguuccugcuggaccuggagcugggccccgagcugaaccccuaccuggcccaccuggccagaauguacaacggccacgccggcggcauggaggugcagaucgugcuggccggcaacgccuucaccgccggcaagauccuguucgccgugaucccccccggcuuccccuacgagaaccugagccccgcccagcugaccaugugcccccacguggugguggacgugagacagcuggagcccauccugcugcccaugcccgacaucagaaacaccuucuuccacuacaaccagagcaacggccccaagagaagacugguggccaugcuguacaccccccugagagccaacaacgccggcgacgacguguucaccgugagcugcagagugcugaccagacccagccccgacuucgaguucaacuuccuggugccccccagcguggagagcaagaccaaggccuucacccugcccgugcugaagaucagcgagaugaccaacagcagauuccccauccccguggaccagauguacaccagcagaaacgagaacaucguggugcagccccagaacggcagagugacccuggacggcgagcugcagggcaccaccacccugcagcccgugagcaucugcggcuucagaggcacccugcagaccagacuggccgaccagcccaacuacaccuaccaggugcaccuggagaaccuggacggcagccccguggaccccaccgacgaggugcccgccccccugggcacccccgacuuccaggcccagcuguucggcgugaucagccagagaagcagcgacaacgccaccagagcccacgaggccagagugaacaccaacgaccccaccuucgccccccagaucgcccaggugagauucaagagccccagcaccgacuucagcgacaacgagcccaucaaguucacccccgugggcaucagcguggacagccagaacagcuacaaccaguggcugcugcccagauacggcggccaccugaccaacaacacccaccuggcccccagcgugagccccauguuccccggcgagcagauccuguucuucagaagcuucaugcccggcgccggcggcuucaccgacggcgccaucgacugccugcugccccaggaguggguggcccacuucuaccaggaggccgccaccgcccagaccgacguggcccugaucagauucgugaaccccgacaccggcagagugcuguucgagggcaagcugcacaagcagggcuucaucaccaucagcaacagcggcgaccaccccaucgugaugcccgccaacggcuacuucagauucgaggccugggugaagcaguucuacagccuggcccccgugggcaccggcagcggcagaagaagagugcaguga

SEQ ID NO: 25852 - RNA, 1614 nt, Artificial Sequence
  derived and/or modified sequence opt4 from VP1__Norovirus_and/or_Norovirus-like__AB303927
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25853 - RNA, 1614 nt, Artificial Sequence
  derived and/or modified sequence opt4 from VP1__Norovirus_and/or_Norovirus-like__AY038600
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaucaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgaccugcagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25854 - RNA, 1614 nt, Artificial Sequence
  derived and/or modified sequence opt4 from VP1__Norovirus_and/or_Norovirus-like__AF080554
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccaaggaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25855 - RNA, 1614 nt, Artificial Sequence
  derived and/or modified sequence opt4 from VP1__Norovirus_and/or_Norovirus-like__AB294778
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25856 - RNA, 1614 nt, Artificial Sequence
  derived and/or modified sequence opt4 from VP1__Norovirus_and/or_Norovirus-like__AB303922
augaagauggccagcaacgacgccacccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagaggcgacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcgacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25857 - RNA, 1614 nt, Artificial Sequence
  derived and/or modified sequence opt4 from VP1__Norovirus_and/or_Norovirus-like__AY532128
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcauccugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25858 - RNA, 1614 nt, Artificial Sequence
  derived and/or modified sequence opt4 from VP1__Norovirus_and/or_Norovirus-like__AY532113
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccaccagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25859 - RNA, 1614 nt, Artificial Sequence
  derived and/or modified sequence opt4 from VP1__Norovirus_and/or_Norovirus-like__EU078406
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacgugaucguggacgugagacagcuggagcccgugcugaucccccugcccgacgugagaaacaacuucuaccacuacaaccaggcccacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgacuucguggugcagccccagaacggcagaugcaccaccgacggcgugcugcugggcaccacccagcugagcgccgugaacaucugcaacuucaagggcgacgugacccacaucgccggcagcagagacuacagaaugaaccuggugagccagaacuggaacaacuacgaccccaccgaggagauccccgccccccugggcacccccgacuuccagggcaagauccagggccugcugacccagaccaccggcgccgacggcagcaccagagcccacaaggccaccgugagcaccggcgccgccaacuucacccccaagcugggcagcgugcaguucaccaccgacaccgacaacgacuuccagaccggccagaacaccaaguucacccccgugggcgugauccaggacggcagccaccaccagaacgagccccagcagugggugcugcccaacuacagcggcagaaccgugcacaacgugcaccuggcccccgccguggcccccaccuuccccggcgagcagcugcuguucuucagaagcaccaugcccggcugcagcggcuaccccaacaugaaccuggacugccugcugccccaggagugggugaugcacuucuaccaggaggccgcccccgcccagagcgacguggcccugcugagauucgugaaccccgacaccggcagagugcuguucgagugcaagcugcacaaggccggcuacaucaccguggcccacaccggccagcacgaccuggugaucccccccaacggcuacuucagauucgacagcugggugaaccaguucuacacccuggcccccaugggcaacggcgccggcagaagaagauga

SEQ ID NO: 25860 - RNA, 1614 nt, Artificial Sequence
  derived and/or modified sequence opt4 from VP1__Norovirus_and/or_Norovirus-like__AF472623
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25861 - RNA, 1614 nt, Artificial Sequence
  derived and/or modified sequence opt4 from VP1__Norovirus_and/or_Norovirus-like__AF427114
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgccagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcagcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25862 - RNA, 1614 nt, Artificial Sequence
  derived and/or modified sequence opt4 from VP1__Norovirus_and/or_Norovirus-like__AY532114
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccaccagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25863 - RNA, 1614 nt, Artificial Sequence
  derived and/or modified sequence opt4 from VP1__Norovirus_and/or_Norovirus-like__KF806505
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25864 - RNA, 1614 nt, Artificial Sequence
  derived and/or modified sequence opt4 from VP1__Norovirus_and/or_Norovirus-like__JQ478407
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacaucacccacaucgccggcagccacgacuacaccaugaaccuggccagccagaacuggagcaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcggcaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25865 - RNA, 1614 nt, Artificial Sequence
  derived and/or modified sequence opt4 from VP1__Norovirus_and/or_Norovirus-like__AB303923
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25866 - RNA, 1614 nt, Artificial Sequence
  derived and/or modified sequence opt4 from VP1__Norovirus_and/or_Norovirus-like__AF427120
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucaucgugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25867 - RNA, 1614 nt, Artificial Sequence
  derived and/or modified sequence opt4 from VP1__Norovirus_and/or_Norovirus-like__AY532134
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaucaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagagccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacgcccuggcccccaugggcaacggcgccggcagaagaagauga

SEQ ID NO: 25868 - RNA, 1614 nt, Artificial Sequence
  derived and/or modified sequence opt4 from VP1__Norovirus_and/or_Norovirus-like__AY532116
augaagauggccagcaacgacgccaaccccagcgacggcagcaccgccaaccuggugcccgaggugaacaacgaggugauggcccuggagcccguggugggcgccgccaucgccacccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25869 - RNA, 1614 nt, Artificial Sequence
  derived and/or modified sequence opt4 from VP1__Norovirus_and/or_Norovirus-like__AY532112
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgcccccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25870 - RNA, 1614 nt, Artificial Sequence
  derived and/or modified sequence opt4 from VP1__Norovirus_and/or_Norovirus-like__KX514275
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgacaccgaggacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25871 - RNA, 1614 nt, Artificial Sequence
  derived and/or modified sequence opt4 from VP1__Norovirus_and/or_Norovirus-like__KF806510
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25872 - RNA, 1614 nt, Artificial Sequence
  derived and/or modified sequence opt4 from VP1__Norovirus_and/or_Norovirus-like__EU078410
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcagaccauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccaggccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 25873 - RNA, 1614 nt, Artificial Sequence
  derived and/or modified sequence opt4 from VP1__Norovirus_and/or_Norovirus-like__AF427123
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacaacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25874 - RNA, 1614 nt, Artificial Sequence
  derived and/or modified sequence opt4 from VP1__Norovirus_and/or_Norovirus-like__AY532135
augaagauggccagcaacgacgccaacccccccgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25875 - RNA, 1614 nt, Artificial Sequence
  derived and/or modified sequence opt4 from VP1__Norovirus_and/or_Norovirus-like__AY532125
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25876 - RNA, 1614 nt, Artificial Sequence
  derived and/or modified sequence opt4 from VP1__Norovirus_and/or_Norovirus-like__AJ277619
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggccuggaggugcagguggugcuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacgacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugagccagaccaccagaggcgacgacagcaccagagcccacaaggccaccgugagcaccggcagcgugcacuucacccccaagcugggcagcgugcaguacaccaccgacaccaacaacgacuucgagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccagcuguacacccuggcccccaugggcaacggcgccggcagaagaagauga

SEQ ID NO: 25877 - RNA, 1614 nt, Artificial Sequence
  derived and/or modified sequence opt4 from VP1__Norovirus_and/or_Norovirus-like__AF080556
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccaggccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25878 - RNA, 1614 nt, Artificial Sequence
  derived and/or modified sequence opt4 from VP1__Norovirus_and/or_Norovirus-like__AF080550
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcagcgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25879 - RNA, 1614 nt, Artificial Sequence
  derived and/or modified sequence opt4 from VP1__Norovirus_and/or_Norovirus-like__EU078407
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagaggcgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 25880 - RNA, 1614 nt, Artificial Sequence
  derived and/or modified sequence opt4 from VP1__Norovirus_and/or_Norovirus-like__AB083781
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcacccugagaggcgacgugacccacaucgccggcagccacgacuacaccaugaaccuggccagccagaacuggaacaacuacgaccccaccgaggagauccccgccccccugggcacccccgacuucgugggcaagauccagggcaugcugagccagaccaccagaggcgacggcagcaccagagcccacaaggccaccgugagcaccggcagcgugcacuucacccccaagcugggcagcgugcaguacaccaccgacaccaacaacgacuucgagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25881 - RNA, 1614 nt, Artificial Sequence
  derived and/or modified sequence opt4 from VP1__Norovirus_and/or_Norovirus-like__AF427122
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccaccagacugagcgccgugaacaucugcaccuucagaggcgacgugacccacaucgccggcagcagagacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgugggcagaagaagauga

SEQ ID NO: 25882 - RNA, 1614 nt, Artificial Sequence
  derived and/or modified sequence opt4 from VP1__Norovirus_and/or_Norovirus-like__AY532133
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugagccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaucaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25883 - RNA, 1614 nt, Artificial Sequence
  derived and/or modified sequence opt4 from VP1__Norovirus_and/or_Norovirus-like__AY532131
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaguguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25884 - RNA, 1614 nt, Artificial Sequence
  derived and/or modified sequence opt4 from VP1__Norovirus_and/or_Norovirus-like__AY532121
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcacccugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcuggaucaaccaguucuacacccuggcccccaugggcaacggcgccggcagaagaagauga

SEQ ID NO: 25885 - RNA, 1614 nt, Artificial Sequence
  derived and/or modified sequence opt4 from VP1__Norovirus_and/or_Norovirus-like__AY532115
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgacgugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25886 - RNA, 1614 nt, Artificial Sequence
  derived and/or modified sequence opt4 from VP1__Norovirus_and/or_Norovirus-like__KF806530
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaacaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25887 - RNA, 1614 nt, Artificial Sequence
  derived and/or modified sequence opt4 from VP1__Norovirus_and/or_Norovirus-like__KF806513
augaagauggccagcaacgacgccagccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcagcaucagauucagcaccgacaccaacaacgacuucgaggccagccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25888 - RNA, 1614 nt, Artificial Sequence
  derived and/or modified sequence opt4 from VP1__Norovirus_and/or_Norovirus-like__AY741811
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugaaggccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25889 - RNA, 1614 nt, Artificial Sequence
  derived and/or modified sequence opt4 from VP1__Norovirus_and/or_Norovirus-like__AY532122
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucggcggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcgacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25890 - RNA, 1614 nt, Artificial Sequence
  derived and/or modified sequence opt4 from VP1__Norovirus_and/or_Norovirus-like__AY532120
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacagcuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacagcgacuuccagaccggccagaacaccaaguucacccccgugggcgugauccaggacggcaacaaccaccagaacgagccccagcagugggugcugcccaacuacagcggcggcaccggccacaacgugcaccuggcccccgccguggcccccaccuuccccggcgagcagcugcuguucuucagaagcaccaugcccggcugcagcggcuaccccaacaugaaccuggacugcuacagcccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25891 - RNA, 1614 nt, Artificial Sequence
  derived and/or modified sequence opt4 from VP1__Norovirus_and/or_Norovirus-like__AY532111
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugagccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccagguguacacccuggcccccaugggcaacggcgccggcagaagaagauga

SEQ ID NO: 25892 - RNA, 1614 nt, Artificial Sequence
  derived and/or modified sequence opt4 from VP1__Norovirus_and/or_Norovirus-like__AF080558
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagaggcgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugacccaggacggcgacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25893 - RNA, 1614 nt, Artificial Sequence
  derived and/or modified sequence opt4 from VP1__Norovirus_and/or_Norovirus-like__KF806508
augaagauggccagcaacgacgccagccccagcgacggcagcgccgccaaccuggugcccgaggugagcaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcaucuuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25894 - RNA, 1614 nt, Artificial Sequence
  derived and/or modified sequence opt4 from VP1__Norovirus_and/or_Norovirus-like__AF425766
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucauccaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgaccuggugggcaagauccagggcaugcugacccagaccaccagagaggacggcagcaccagagcccacaaggccaccgugagcaccggcagcgugcacuucacccccaagcugggcagcgugcaguacaccaccgacaccagcaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25895 - RNA, 1614 nt, Artificial Sequence
  derived and/or modified sequence opt4 from VP1__Norovirus_and/or_Norovirus-like__AJ583672
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaccaucuucgccgccgugccccccaacuuccccaccgagggccugagccccagccaggugaccauguucccccacaucaucguggacgugagacagcccgagcccgugcugaucccccugcccgacgugagaaacaacuucuaccacuacaaccagagcaacgaccccaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcaacgccuucguggugcagccccagaacggcagaugcaccaccgacggcgugcugcugggcaccacccagcugagccccgugaacaucugcaccuucagaggcgacgugacccacaucgccggcacccacgacuacaccaugaaccuggccagccagaacuggaacaacuacgaccccaccgaggagauccccgccccccugggcacccccgacuucgugggcaagauccagggcgugcugagccagaccaccagaggcgacggcagcaccagaggccacaaggccaccgugagcaccggcagcgugcacuucacccccaagcugggcagcgugcaguacaccaccgacaccaacaacgaccuggaggccggccagagcaccaaguucacccccgugggcguggugcaggacggcaacaaccaccagaacgagccccagcagugggugcugcccaacuacagcggcagaaccggccacaacgugcaccuggugcccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcaccggcagaagaagauga

SEQ ID NO: 25896 - RNA, 1614 nt, Artificial Sequence
  derived and/or modified sequence opt4 from VP1__Norovirus_and/or_Norovirus-like__AY532119
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacagcgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25897 - RNA, 1614 nt, Artificial Sequence
  derived and/or modified sequence opt4 from VP1__Norovirus_and/or_Norovirus-like__AF080552
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccagcggcuacuucagauucgacagcugggugaaccaguucuacacccuggcccccaugggcaacggcgccggcagaagaagauga

SEQ ID NO: 25898 - RNA, 1614 nt, Artificial Sequence
  derived and/or modified sequence opt4 from VP1__Norovirus_and/or_Norovirus-like__KX514177
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25899 - RNA, 1614 nt, Artificial Sequence
  derived and/or modified sequence opt4 from VP1__Norovirus_and/or_Norovirus-like__KF806514
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacugggacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25900 - RNA, 1614 nt, Artificial Sequence
  derived and/or modified sequence opt4 from VP1__Norovirus_and/or_Norovirus-like__AB303925
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguucaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcuggaucaaccaguucuacacccuggcccccaugggcaacggcgccggcagaagaagauga

SEQ ID NO: 25901 - RNA, 1614 nt, Artificial Sequence
  derived and/or modified sequence opt4 from VP1__Norovirus_and/or_Norovirus-like__KF806534
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25902 - RNA, 1614 nt, Artificial Sequence
  derived and/or modified sequence opt4 from VP1__Norovirus_and/or_Norovirus-like__KF806519
augaagauggccagcaacgacgccagccccagcgacggcagcgccgccaaccuggugcccgaggugaacaacgaggugauggcccuggagcccguggugggcgccaccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugagccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25903 - RNA, 1614 nt, Artificial Sequence
  derived and/or modified sequence opt4 from VP1__Norovirus_and/or_Norovirus-like__AB303924
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccguguucugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25904 - RNA, 1614 nt, Artificial Sequence
  derived and/or modified sequence opt4 from VP1__Norovirus_and/or_Norovirus-like__DQ975270
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaaccuacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25905 - RNA, 1614 nt, Artificial Sequence
  derived and/or modified sequence opt4 from VP1__Norovirus_and/or_Norovirus-like__AF414424
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugggccagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaccccccccaacggcuacuucagauucgacagcugggugaaccaguucuacacccuggcccccaugggcaacggcgccggcagaagaagauga

SEQ ID NO: 25906 - RNA, 1614 nt, Artificial Sequence
  derived and/or modified sequence opt4 from VP1__Norovirus_and/or_Norovirus-like__LC048964
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaagcaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagaaccagggccugcugagccagaccaccagaggcgacggcagcaccagagcccacaaggccaccgugagcaccggcagcgugcacuucacccccaagcugggcagcgugcaguacaccaccgacaccaacaacgacuucgagaccggccagaacaccaaguucacccccgugggcgugauccaggacggcaacaaccaccagaacgagccccagcagugggcccugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25907 - RNA, 1614 nt, Artificial Sequence
  derived and/or modified sequence opt4 from VP1__Norovirus_and/or_Norovirus-like__AB684705
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugagccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagacccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacagcagcaccagagcccacaaggccacccugagcaccggcagcgugcacuucacccccaagcugggcagcgugcaguucaccaccgacaccaacaacgacuuccagaccggccagaacaccaaguucacccccgugggcgugauccaggacagcgaccaccaccagaacgagccccagcagugggugcugcccaacuacagcggcagcagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25908 - RNA, 1614 nt, Artificial Sequence
  derived and/or modified sequence opt4 from VP1__Norovirus_and/or_Norovirus-like__KF806523
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugagccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucaccggcaccagcgaguacgccaugaaccuggccagccagaacuggaacaacuacgaccccaccgaggagauccccgccccccugggcgcccccgacuucgugggcaagaucagaggcaugcugacccagaccaccagaagagacggcagcaccagaggccacagagccacccugagcaccggcagcgcccacuucacccccaagcugggcaacaucagauucagcaccgacaccaacaacgacuucgaggccggccagaacaccaaguucacccccgugggcguguuccaggagggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcggcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25909 - RNA, 1614 nt, Artificial Sequence
  derived and/or modified sequence opt4 from VP1__Norovirus_and/or_Norovirus-like__AY532129
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccacggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacagcuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25910 - RNA, 1614 nt, Artificial Sequence
  derived and/or modified sequence opt4 from VP1__Norovirus_and/or_Norovirus-like__AY532124
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccagaaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25911 - RNA, 1614 nt, Artificial Sequence
  derived and/or modified sequence opt4 from VP1__Norovirus_and/or_Norovirus-like__KX514309
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccaccccggcggcagcaagaucuacaccaugaaccuggccagccccaacuggaacaacuacgaccccaccgaggagauccccgccccccugggcacccccgacuucgugggcaagauccacggcaugcugacccagaccaccaagggcgagggcagcaccagaggccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25912 - RNA, 1614 nt, Artificial Sequence
  derived and/or modified sequence opt4 from VP1__Norovirus_and/or_Norovirus-like__KX514308
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggacaagcuguucaccggccccagcagcgccaacguggugcagccccagaacggcagaugcaccaucgacggcgagcugcugggcaccacccagcugagcagcgugaacaucugcaccuucagaggcgacgugacccacaucggcagcaccagacacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgacaccgaggacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25913 - RNA, 1614 nt, Artificial Sequence
  derived and/or modified sequence opt4 from VP1__Norovirus_and/or_Norovirus-like__KX514283
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaaggacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgugacccuggacaagcuguucaccggccccagcagcaccaucguggugcagccccagaacggcagaugcaugaucgacggcgugcugcugggcaccacccagcugagccccgugaacaucugcaccuucagaggcgacgugacccaccccagagacagcaccaucuacaccaugaaccuggccagccccaacuggaacaacuacgaccccaccgaggagauccccgccccccugggcacccccgacuucaccggcaagauccagggcaugcugacccagaccaccaagggcgagggcagcaccagaggccacagagccaccguguacgugggcagcgccgaguucacccccaagcugggcaaggugagauucgagaccgacaccgaggacgaccuggugaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25914 - RNA, 1614 nt, Artificial Sequence
  derived and/or modified sequence opt4 from VP1__Norovirus_and/or_Norovirus-like__KX514194
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcaacggcagcaccagaggccacagagccaccguguacgugggcagcgccgaguucacccccaagcugggcaaggugcaguucaagaccgagaccgaccacgaccuggccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25915 - RNA, 1614 nt, Artificial Sequence
  derived and/or modified sequence opt4 from VP1__Norovirus_and/or_Norovirus-like__KY424340
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggccagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25916 - RNA, 1614 nt, Artificial Sequence
  derived and/or modified sequence opt4 from VP1__Norovirus_and/or_Norovirus-like__LC016606
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcacccacaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgccaccgacaccaacaacgacuucgagaccggccagaacaccagauucacccccgugggcgugauccaggacggcagcgcccacagaaacgagccccagcagugggugcugcccgacuacagcggcaagaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25917 - RNA, 1614 nt, Artificial Sequence
  derived and/or modified sequence opt4 from VP1__Norovirus_and/or_Norovirus-like__FJ537136
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggugagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25918 - RNA, 1614 nt, Artificial Sequence
  derived and/or modified sequence opt4 from VP1__Norovirus_and/or_Norovirus-like__AY532117
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcugggccccuggggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccagcaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggccccuacgaccuggugaucccccccaacggcuacuucagauucgacagcugggugaaccaguucuacacccuggcccccaugggcaacggcgccggcagaagaagauga

SEQ ID NO: 25919 - RNA, 1614 nt, Artificial Sequence
  derived and/or modified sequence opt4 from VP1__Norovirus_and/or_Norovirus-like__KX514279
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccaccacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgacaccgaggacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25920 - RNA, 1614 nt, Artificial Sequence
  derived and/or modified sequence opt4 from VP1__Norovirus_and/or_Norovirus-like__LC016602
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacaucagcggcaccagcaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgacaccgacaccaacaacgaccuggagaccggccagaacaccagauucacccccgugggcgugauccaggacggcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25921 - RNA, 1614 nt, Artificial Sequence
  derived and/or modified sequence opt4 from VP1__Norovirus_and/or_Norovirus-like__AF145896
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggccagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuucgaccuggugaucccccccaacggcuacuucagauucgacagcugggugaaccaguucuacacccuggcccccaugggcaacggcaccggcagaagaagauga

SEQ ID NO: 25922 - RNA, 1614 nt, Artificial Sequence
  derived and/or modified sequence opt4 from VP1__Norovirus_and/or_Norovirus-like__AB684704
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugagccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcaaguuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaccagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuucgagaccggccagaacaccaaguucacccccgugggcgugauccaggacggcgaccaccaccagaacgagccccagcagugggugcugcccagcuacagcggcagcagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25923 - RNA, 1614 nt, Artificial Sequence
  derived and/or modified sequence opt4 from VP1__Norovirus_and/or_Norovirus-like__JX401279
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaccagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccgacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccgccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25924 - RNA, 1614 nt, Artificial Sequence
  derived and/or modified sequence opt4 from VP1__Norovirus_and/or_Norovirus-like__GQ389627
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggagcaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucugccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25925 - RNA, 1614 nt, Artificial Sequence
  derived and/or modified sequence opt4 from VP1__Norovirus_and/or_Norovirus-like__AF425763
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccagaggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcccuacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccagacugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25926 - RNA, 1614 nt, Artificial Sequence
  derived and/or modified sequence opt4 from VP1__Norovirus_and/or_Norovirus-like__AY532127
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacggcagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcacccugacccagaccaccagagaggacggcagcaccagagcccacaaggccaccgugagcaccggcagcgugcacuucacccccaagcugggcagcgcccaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25927 - RNA, 1614 nt, Artificial Sequence
  derived and/or modified sequence opt4 from VP1__Norovirus_and/or_Norovirus-like__AY532118
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugggccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccgugccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagcagagacuacaccaugaaccuggccagccagaacuggaacaacuacgaccccaccgaggagauccccgccccccugggcacccccgacuucgugggcaagauccagggcgugcugacccagaccaccagagaggacggcagcaccagagcccacaaggccaccgugagcaccggcagcgugcacuucacccccaagcugggcagcgugcaguacaccaccgacaccgacaacgacuuccagaccggccagaacaccaaguucacccccgugggcgugauccaggacggcaacaaccaccagaacgagccccagcagugggugcugcccaacuacagcggcagacccggccacaacgugcaccuggcccccgccguggcccccaccuuccugggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25928 - RNA, 1614 nt, Artificial Sequence
  derived and/or modified sequence opt4 from VP1__Norovirus_and/or_Norovirus-like__KX514326
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccguggacgaccuggagaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25929 - RNA, 1614 nt, Artificial Sequence
  derived and/or modified sequence opt4 from VP1__Norovirus_and/or_Norovirus-like__KX514264
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguuccagaccgagaccgaggacgaccuggugaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcaccauccccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25930 - RNA, 1614 nt, Artificial Sequence
  derived and/or modified sequence opt4 from VP1__Norovirus_and/or_Norovirus-like__KX514171
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccagcacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25931 - RNA, 1614 nt, Artificial Sequence
  derived and/or modified sequence opt4 from VP1__Norovirus_and/or_Norovirus-like__KX514170
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccagcacuggaucaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25932 - RNA, 1614 nt, Artificial Sequence
  derived and/or modified sequence opt4 from VP1__Norovirus_and/or_Norovirus-like__KF806533
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaccaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcgugagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25933 - RNA, 1614 nt, Artificial Sequence
  derived and/or modified sequence opt4 from VP1__Norovirus_and/or_Norovirus-like__KF806528
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccugggaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggaacaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25934 - RNA, 1614 nt, Artificial Sequence
  derived and/or modified sequence opt4 from VP1__Norovirus_and/or_Norovirus-like__KF806527
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcgugagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25935 - RNA, 1614 nt, Artificial Sequence
  derived and/or modified sequence opt4 from VP1__Norovirus_and/or_Norovirus-like__KX514261
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguuccagaccgagaccgaggacgaccuggugaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25936 - RNA, 1614 nt, Artificial Sequence
  derived and/or modified sequence opt4 from VP1__Norovirus_and/or_Norovirus-like__AB684720
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucagaggcagcagagacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccgacaacgacuuccagaccggccagaacaccaaguucacccccgugggcgugauccaggacagcgaccaccaccagaacgagccccagcagugggugcugcccaacuacagcggcgccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25937 - RNA, 1614 nt, Artificial Sequence
  derived and/or modified sequence opt4 from VP1__Norovirus_and/or_Norovirus-like__LC016605
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccagaucaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgacaccgacaccaacaacgaccuggagaccggccagaacaccagauucacccccgugggcgugauccaggacggcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25938 - RNA, 1614 nt, Artificial Sequence
  derived and/or modified sequence opt4 from VP1__Norovirus_and/or_Norovirus-like__KF806529
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcggcgccuucguggugcagccccagaacggcagaugcaccaccgacggcgugcugcugggcaccacccagcugagccccgugaacaucugcaccuucagaggcgaccugacccacuucgccggcacccacgaguacgccaugaaccuggccagccagaacuggagcaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccgacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25939 - RNA, 1614 nt, Artificial Sequence
  derived and/or modified sequence opt4 from VP1__Norovirus_and/or_Norovirus-like__JX023286
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25940 - RNA, 1614 nt, Artificial Sequence
  derived and/or modified sequence opt4 from VP1__Norovirus_and/or_Norovirus-like__FJ537137
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggugagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucauccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccgugcccggcugcagcggcuaccccaacaugaaccuggacugccugcugccccaggagugggugagccacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugcugccccccaacggcuacuucagauucgacagcugggugaaccaguucuacacccuggcccccaugggcaacggcaccggcagaagaagauga

SEQ ID NO: 25941 - RNA, 1614 nt, Artificial Sequence
  derived and/or modified sequence opt4 from VP1__Norovirus_and/or_Norovirus-like__X76716
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggccaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgccggcagccacgacuacaccaugaaccuggccagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccaggccggccagaacaccaaguucacccccgugggcgugauccaggacggcgaccaccaccagaacgagccccagcaguggcugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugcugccccccaacggcuacuucagauucgacagcugggugaaccaguucuacacccuggcccccaugggcaacggcaccggcagaagaagauga

SEQ ID NO: 25942 - RNA, 1614 nt, Artificial Sequence
  derived and/or modified sequence opt4 from VP1__Norovirus_and/or_Norovirus-like__KX514328
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccguggacgaccuggagaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25943 - RNA, 1614 nt, Artificial Sequence
  derived and/or modified sequence opt4 from VP1__Norovirus_and/or_Norovirus-like__KX514201
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacgugaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugaccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25944 - RNA, 1614 nt, Artificial Sequence
  derived and/or modified sequence opt4 from VP1__Norovirus_and/or_Norovirus-like__AB985442
augaagauggccagcagcgacgccaaccccagcgacggcagcgccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggccagccagaacuggagcaacuacgaccccaccgaggagauccccgccccccugggcacccccgacuucgugggcaagauccagggccugagaacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25945 - RNA, 1614 nt, Artificial Sequence
  derived and/or modified sequence opt4 from VP1__Norovirus_and/or_Norovirus-like__LC016604
augaagauggccagcaacgacgccagccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgacgugacccacauccccggcaccagaaccuacagaaugaaccuggccagccagaacuggaacaacuacgaccccaccgaggagauccccgccccccugggcacccccgacuucgugggcaagauccagggcaugcugacccagaccaccaagggcgacggcagcaccagaggccacaaggccaccgugagcaccggcagcguggacuucacccccaagcugggcagcgugcaguucgacaccgacaccaacaacgaccuggagaccggccagaacaccagauucacccccgugggcgugauccaggacggcagcgcccacagaaacgagccccagcagugggugcugcccgacuacagcggcagaaccgugcacaacgugcaccuggcccccgccguggcccccaccuuccccggcgagcagcugcuguucuucagaagcaccaugcccggcugcagcggcuaccccaacauggaccuggacugccugcugccccaggagugggugcagcacuucuaccaggaggccgcccccgcccagagcgacguggcccugcugagauucgugaaccccgacaccggcagagugcuguucgagugcaagcugcacaagaccggcuacgugaccguggcccacaccggccagcacgaccuggugaucccccccaacggcuacuucagauucgacagcugggugaaccaguucuacacccuggcccccaugggcaacggcgccggcagaagaagauga

SEQ ID NO: 25946 - RNA, 1614 nt, Artificial Sequence
  derived and/or modified sequence opt4 from VP1__Norovirus_and/or_Norovirus-like__KF806532
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccaacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaagagacggcagcaccagaggccacagagccacccugagcaccggcagcgcccacuucacccccaagcugggcagcaucagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugacccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25947 - RNA, 1614 nt, Artificial Sequence
  derived and/or modified sequence opt4 from VP1__Norovirus_and/or_Norovirus-like__FJ537138
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugaccagagugggcaucagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25948 - RNA, 1614 nt, Artificial Sequence
  derived and/or modified sequence opt4 from VP1__Norovirus_and/or_Norovirus-like__AY030098
augaagauggccagcagcgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggugagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccgacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugaucccccccaacggcuacuucagauucgacagcugggugaaccaguucuacacccuggcccccaugggcaacggcaccggcagaagaagauga

SEQ ID NO: 25949 - RNA, 1614 nt, Artificial Sequence
  derived and/or modified sequence opt4 from VP1__Norovirus_and/or_Norovirus-like__AY532130
augaagauggccagcaacgacgccaaccccagcgacggcagcaccgccaaccuggugcccgaggugaacaacgaggugauggcccuggagcccguggugggcgccgccaucgccgcccccguggccggccagcagaacaucaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccagcaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaucaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgcccacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccagcuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugagaaacggcgccggcagaagaagauga

SEQ ID NO: 25950 - RNA, 1614 nt, Artificial Sequence
  derived and/or modified sequence opt4 from VP1__Norovirus_and/or_Norovirus-like__KX514286
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgacaccgaggacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25951 - RNA, 1614 nt, Artificial Sequence
  derived and/or modified sequence opt4 from VP1__Norovirus_and/or_Norovirus-like__KX514202
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugaccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25952 - RNA, 1614 nt, Artificial Sequence
  derived and/or modified sequence opt4 from VP1__Norovirus_and/or_Norovirus-like__DQ358208
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggccaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccgugcugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgccggcagccacgacuacaccaugaaccuggccagccagaacuggagcaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccaggccggccagaacaccaaguucacccccgugggcgugauccaggacggcgaccaccaccagaacgagccccagcaguggagccugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcggcuacaucaccguggcccacaccggccccuacgaccuggugcugccccccaacggcuacuucagauucgacagcugggugaaccaguucuacacccuggcccccaugggcaacggcaccggcagaagaagauga

SEQ ID NO: 25953 - RNA, 1614 nt, Artificial Sequence
  derived and/or modified sequence opt4 from VP1__Norovirus_and/or_Norovirus-like__AF414425
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgccagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgccagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagagcggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucaagagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25954 - RNA, 1614 nt, Artificial Sequence
  derived and/or modified sequence opt4 from VP1__Norovirus_and/or_Norovirus-like__KX514348
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccguggacgaccuggagaucagacagaacaccaaguucacccccgugggcgugauccagagcagcgaccaccacagagacgagccccagcagugggugcugcccagcuacagcggcagagacacccccaacgugcaccuggcccccgccguggcccccaacuuccccggcgagcagcugcuguucuucagaagcacccugcccggcugcggcggccaccacaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25955 - RNA, 1614 nt, Artificial Sequence
  derived and/or modified sequence opt4 from VP1__Norovirus_and/or_Norovirus-like__KX514287
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccaccacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25956 - RNA, 1614 nt, Artificial Sequence
  derived and/or modified sequence opt4 from VP1__Norovirus_and/or_Norovirus-like__KX514183
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccagcacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25957 - RNA, 1614 nt, Artificial Sequence
  derived and/or modified sequence opt4 from VP1__Norovirus_and/or_Norovirus-like__KX514174
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccagcacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25958 - RNA, 1614 nt, Artificial Sequence
  derived and/or modified sequence opt4 from VP1__Norovirus_and/or_Norovirus-like__KF429791
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccggccaggugaccauguucccccacaucaucguggacgugagacagcuggagcccgugcugaucccccugcccgacgugagaaacaacuucuaccacuacaaccagagcaacgaccccaccaucaagcugguggccaugcuguacaccccccugagagccaacaacgccggcgacgacguguucaccgugagcugcagagugcugaccagacccagccccgacuucgacuucaucuuccuggugccccccaccaucgagagcaagaccaagagcuucagcgugcccauccugaccaucgaggagaugaccaacagcagauuccccaucccccuggagaagcuguucaccggccccagcagcacccugguggugcagccccagaacggcagaugcaccaccgacggcgugcugcugggcaccacccagcugagccccgugaacaucugcaccuucagaggcgacgugacccagaucaccaacacccacagcuacgagaugaaccuggccgcccagaacuggaacagcuacgaccccaccgaggagauccccgccccccugggcacccccgacuucgugggcaagauccagggcgugcugacccagaccaccaaggagaacggcagcaccagagcccacaaggccaccguguacaccggcagcaccggcuucacccccaagcugggcagagugcaguucgugaccgacaccgacagagaccuggagaccaaccaggacaccaaguucacccccgugggcgugauccaggacggcgacgcccaccagaacgagccccagcagugggugcugcccagcuaccugggcaccaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggcagacacgaccuggugaucccccccaacggcuacuucagauucgacagcugggugagccccuucuacacccuggcccccaugggcaacggcaccggcagaagaagauga

SEQ ID NO: 25959 - RNA, 1614 nt, Artificial Sequence
  derived and/or modified sequence opt4 from VP1__Norovirus_and/or_Norovirus-like__AF427115
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccauccccauccugaccggcgaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucaagggcaacgugauccacaucgccggcagccacgacuacaccaugaaccuggccagccagaacuggaacaacuacgaccccaccgaggagacccccgccccccugggcacccccgacuucgugggcaagauccagggccugcugacccagaccaccagagaggacggcagcaccagagcccacaaggccaccgugagcgccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagagccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25960 - RNA, 1614 nt, Artificial Sequence
  derived and/or modified sequence opt4 from VP1__Norovirus_and/or_Norovirus-like__KX514314
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25961 - RNA, 1614 nt, Artificial Sequence
  derived and/or modified sequence opt4 from VP1__Norovirus_and/or_Norovirus-like__KX514208
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25962 - RNA, 1614 nt, Artificial Sequence
  derived and/or modified sequence opt4 from VP1__Norovirus_and/or_Norovirus-like__KX514206
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25963 - RNA, 1614 nt, Artificial Sequence
  derived and/or modified sequence opt4 from VP1__Norovirus_and/or_Norovirus-like__KX514198
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugaccaccagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25964 - RNA, 1614 nt, Artificial Sequence
  derived and/or modified sequence opt4 from VP1__Norovirus_and/or_Norovirus-like__KX514191
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25965 - RNA, 1614 nt, Artificial Sequence
  derived and/or modified sequence opt4 from VP1__Norovirus_and/or_Norovirus-like__KX514187
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccaccagacacuggaccaugaaccuggugagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25966 - RNA, 1614 nt, Artificial Sequence
  derived and/or modified sequence opt4 from VP1__Norovirus_and/or_Norovirus-like__KX514180
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucauccaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25967 - RNA, 1614 nt, Artificial Sequence
  derived and/or modified sequence opt4 from VP1__Norovirus_and/or_Norovirus-like__GU598213
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgacagcuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggagcaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucugccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25968 - RNA, 1614 nt, Artificial Sequence
  derived and/or modified sequence opt4 from VP1__Norovirus_and/or_Norovirus-like__KX514365
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucagaagcacccagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25969 - RNA, 1614 nt, Artificial Sequence
  derived and/or modified sequence opt4 from VP1__Norovirus_and/or_Norovirus-like__KX514304
augaagauggugagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25970 - RNA, 1614 nt, Artificial Sequence
  derived and/or modified sequence opt4 from VP1__Norovirus_and/or_Norovirus-like__KX514302
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcagagugcaguucgagaccgacaccaccgacgaccuggacgcccaccagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25971 - RNA, 1614 nt, Artificial Sequence
  derived and/or modified sequence opt4 from VP1__Norovirus_and/or_Norovirus-like__KX514207
augaagauggccagcagcgacgccaaccccagcgacggcagcgccgccaaccuggugcccgaggugaacaacgaggugauggcccuggagcccguggugggcgccgccaucaccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggugagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugagcaucagacagaacaccaaguucacccccgugggcgugauccaggagagcgaccaccacagagacgagccccagcaguggagacugcccaacuacagcggcgccaacgccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25972 - RNA, 1614 nt, Artificial Sequence
  derived and/or modified sequence opt4 from VP1__Norovirus_and/or_Norovirus-like__KX514192
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcgccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25973 - RNA, 1614 nt, Artificial Sequence
  derived and/or modified sequence opt4 from VP1__Norovirus_and/or_Norovirus-like__KF806525
augaagauggccagcaacgacgccagccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucgugguggacgugagacagcuggagcccgugcugaucccccugcccgacgugagaaacaacuucuaccacuacaaccagagcaaggaccccaccaucaagcugaucgccaugcuguacaccccccugagagccaacaacgccggcgaggacguguucaccgugagcugcagagugcugaccagacccagccccgacuucgacuucaucuuccuggugccccccaccguggagagcagaagcaagcccuucaccgugcccauccugaccguggaggagaugaccuacagcagauuccccaucccccuggagaagcuguucaccggccccagcagcgccuucguggugcagccccagaacggcagaugcaccaccgacggcgugcugcugggcaccacccagcugagccccgugaacaucugcaccuucagaggcgaccugacccacuucgccggcaccagcgaguacgccaugaaccuggccagccagaacuggaccaacuacgaccccaccgaggagauccccgccccccugggcgcccccgacuucgugggcaagaucagaggcgugcugacccagaccaccagaggcgacggcagcaccagaggccacagagccacccugagcaccggcagcgcccacuucacccccaagcugggcagcgugagauucagcaccgacaccaacaacgacuucgaggccggccagaacaccaaguucacccccgugggcguguuccaggacggcgacaaccaccagaacgagccccagcagugggugcugcccaacuacagcggcgccaccgcccacaacgugcaccuggcccccgccguggcccccgccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25974 - RNA, 1614 nt, Artificial Sequence
  derived and/or modified sequence opt4 from VP1__Norovirus_and/or_Norovirus-like__KC462195
augaagauggccagcaacgacaccauccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcaugccccugagccccgaccugaaccccuaccugagccaccugagcagaauguacaacggcuacgccggcggcuucgaggugcaggugauccuggccggcaacgccuucaccgccggcaagaucaucuucgccgccaucccccccaacuuccccaccgacggccugagccccagccaggugaccauguucccccacaucaucguggacgugagacagcuggagcccgugcugaucccccugcccgacgugagaaacaacuucuaccacuacaaccaggugaacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggacgagaugaccaacagcagauuccccaccccccuggagagacugcacaccggccccaacaacagccugguggugcagccccagaacggcagaugcaccaucgacggcgugcugcugggcaccacccagcugagcgccgugaacaucugcagcuucagaggcgacagcaccaccagagagggccagagccacgccuacaccaugaaccuggccagccagaacuggaccaacuacgaccccaccgaggacauccccgccccccugggcacccccgacuucgugggcaagaucgugggcaugcugagccagaccaccagagagaacagcagcaccagagcccacaaggccaccgugagcaccggcgacgcccacuucaugcccaagcugggcagcgugcuguucaccaccgacaccgaggaccugcagaacggccagaacaccagauucacccccgugggcguggcccaggacggcgagccccaccagaacgagccccagcaguggagacugcccaacuacagcggcacccccggccacaacgugcaccuggccccccccguggcccccaccuuccccggcgagcagcugcuguucuucagaagcaccaugcccggcugcggcggcuaccccaacauggaccuggacugccugcugccccaggagugggugagacacuucuaccaggaggccgcccccgcccagagcgacguggcccugcugagauucgugaaccccgacaccggcagagugcuguucgagugcaagcugcacaaggccggcuacaucaccgugagccacaccggccccuacgaccuggugaucccccccaacggcuacuucagauucgacagcugggugaaccaguucuacgcccuggcccccaugggcaccggcaccggcagaagaagauga

SEQ ID NO: 25975 - RNA, 1614 nt, Artificial Sequence
  derived and/or modified sequence opt4 from VP1__Norovirus_and/or_Norovirus-like__AF427116
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccauccccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcaacgugauccacaucgccggcagccacgacuacaccaugaaccuggccagccagaacuggaacaacuacgaccccaccgaggagacccccgccccccugggcaccagcgacuucgugggcaagauccagggccugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagagccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25976 - RNA, 1614 nt, Artificial Sequence
  derived and/or modified sequence opt4 from VP1__Norovirus_and/or_Norovirus-like__KX514337
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcgccaccagacacuggaccaugaaccuggccagccccaacuggaacaacuacgaccccaccgaggagacccccgccccccugggcacccccgacuucgugggcaaggugcacggcaugcugacccagaccacccagggcagcggcagcaccagagcccacagagccaccguguacgugggcggcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaaagagauga

SEQ ID NO: 25977 - RNA, 1614 nt, Artificial Sequence
  derived and/or modified sequence opt4 from VP1__Norovirus_and/or_Norovirus-like__KX514255
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcagcgccgacuucacccccaagcugggcaaggugcaguucgagaccgagaccgacuacgaccuggccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25978 - RNA, 1614 nt, Artificial Sequence
  derived and/or modified sequence opt4 from VP1__Norovirus_and/or_Norovirus-like__KX514210
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugagcaccagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25979 - RNA, 1614 nt, Artificial Sequence
  derived and/or modified sequence opt4 from VP1__Norovirus_and/or_Norovirus-like__KX514182
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccagcacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaaagagauga

SEQ ID NO: 25980 - RNA, 1614 nt, Artificial Sequence
  derived and/or modified sequence opt4 from VP1__Norovirus_and/or_Norovirus-like__AF425764
augaagauggccagcaacgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcggcuucaccgugagccccagaaacgcccccggcgagauccuguggagcgccccccugggccccgaccugaaccccuaccugagccaccuggccagaauguacaacggcuacgccggcggcuucgaggugcaggugauccuggccggcagcgccagcaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaacaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccagaacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagagcgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25981 - RNA, 1614 nt, Artificial Sequence
  derived and/or modified sequence opt4 from VP1__Norovirus_and/or_Norovirus-like__KX514355
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcacccagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccagcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25982 - RNA, 1614 nt, Artificial Sequence
  derived and/or modified sequence opt4 from VP1__Norovirus_and/or_Norovirus-like__KX514345
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaagcaagcccuucagcgugcccgugcugaccguggaggagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcgccaccagacacuggaccaugaaccuggccagccugaacuggaacaacuacgaccccaccgaggagacccccgccccccugggcacccccgacuucgugggcaagauccacggcaugcugacccagaccacccagggcagcggcagcaccagagcccacagagccaccguguacgugggcgccgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25983 - RNA, 1614 nt, Artificial Sequence
  derived and/or modified sequence opt4 from VP1__Norovirus_and/or_Norovirus-like__KX514204
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugcaguucaagaccgagaccgaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25984 - RNA, 1614 nt, Artificial Sequence
  derived and/or modified sequence opt4 from VP1__Norovirus_and/or_Norovirus-like__KF712492
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccaccugaucguggacgugagacagcuggagcccgugaugaucccccugcccgacaucagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaccaccaagacccacaccuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcagcgccgaguucacccccaagcugggcagaauccagcuguucaccgacaccgacaacgaccuggaggccaaccagaacaccaaguucacccccgugggcgugauccaggacggcgacacccaccagaacgagccccagcagugggugcugcccagcuacagcggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuguucaucccccccaacggcuacuucagauucgacagcugggugagccccuucuacacccuggcccccaugggcaacggcaccggcagaagaagauga

SEQ ID NO: 25985 - RNA, 1614 nt, Artificial Sequence
  derived and/or modified sequence opt4 from VP1__Norovirus_and/or_Norovirus-like__DQ078829
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccccagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggaccccgugcugauccccagccccgacgugagaaacaacuucuaccacuacaaccagagcaacgacagcaccaucaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaccuucagaggcgacgugacccacaucgccggcagccacgacuacaccaugaaccuggccagccagaacuggaucaacuacgaccccaccgaggagauccccgccccccugggcacccccgacuucgugggcaagauccagggcaugcugacccagaccaccagagaggacggcagcaccagagcccacaaggccaccgugagcaccggcagcgugcacuucacccccaagcugggcagcgugcaguacaccaccgacaccaacaacgacuuccagaccggccaggacaccaaguucacccccgugggcgugauccaggacggcaacaaccaccagaacgagccccagcagugggugcugcccaacuacagcggcagaaccggccacaacgugcaccuggcccccgccguggcccccaccuuccccggcgagcagcugcuguucuucagaagcaccaugcccggcugcagcggcuaccccaacaugaaccuggacugccugcugccccaggagugggugcagcacuucuaccaggaggccgcccccgcccagcccgacguggcccugcugagauucgugaaccccgacaccggcagagugcuguucgagugcaagcugcacaagagcggcuacgugaccguggcccacaccggcccccacgaccuggugaucccccccaacggcuacuucagauucgacagcugggugaaccaguucuacacccuggcccccaugggcaacggcgccggcagaagaagauga

SEQ ID NO: 25986 - RNA, 1614 nt, Artificial Sequence
  derived and/or modified sequence opt4 from VP1__Norovirus_and/or_Norovirus-like__KX514370
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcgccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugagauucgagaccgacaccgaggacgaccuggugaucagacagaacaccaaguucacccccgugggcgugauccagagcagcgagcaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25987 - RNA, 1614 nt, Artificial Sequence
  derived and/or modified sequence opt4 from VP1__Norovirus_and/or_Norovirus-like__KX514332
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccguggacgaccuggagaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25988 - RNA, 1614 nt, Artificial Sequence
  derived and/or modified sequence opt4 from VP1__Norovirus_and/or_Norovirus-like__KX514276
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcaccacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugagauucgagaccgacaccgaggacgaccuggugaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25989 - RNA, 1614 nt, Artificial Sequence
  derived and/or modified sequence opt4 from VP1__Norovirus_and/or_Norovirus-like__KX514256
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagggccuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacagcuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccaaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugccccccaacggcuacuucagauucgacagcugggugaaccaguucuacacccuggcccccaugggcaacggcaccggcagaagaagauga

SEQ ID NO: 25990 - RNA, 1614 nt, Artificial Sequence
  derived and/or modified sequence opt4 from VP1__Norovirus_and/or_Norovirus-like__KX514209
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgaccugaucuuccuggugccccccaccguggagagcagaaccaagcccuucagcgugcccauccugaccgugggcgagaugaccaacagcagauuccccgugaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25991 - RNA, 1614 nt, Artificial Sequence
  derived and/or modified sequence opt4 from VP1__Norovirus_and/or_Norovirus-like__KX514205
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugcaguucaagaccgagaccgaccacgaccugagcaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccagcacgaccuggugaucccccccaacggcuacuucagauucgacagcugggugaaccaguucuacacccuggcccccaugggcaacggcaccggcagaagaagauga

SEQ ID NO: 25992 - RNA, 1614 nt, Artificial Sequence
  derived and/or modified sequence opt4 from VP1__Norovirus_and/or_Norovirus-like__KX514200
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagccccgugaacaucugcaccuucagaggcgacgugacccacaucggcaccaccagacacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcagcgccgaguucacccccaagcugggcaaggugcaguucaagaccgagaccgaccacgaccugagcaucagacagaacaccaaguucacccccgugggcgugauccagaagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25993 - RNA, 1614 nt, Artificial Sequence
  derived and/or modified sequence opt4 from VP1__Norovirus_and/or_Norovirus-like__KX514196
augaagauggccagcagcgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacguguucaccgccggcaagaucaucuucgccgccgugccccccaccuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccacaucggcagcacccaccacuggaccaugaaccuggccagccccaacuggaacaacuacgaccccaccgaggagacccccgccccccugggcacccccgacuucgugggcaagauccacggcaugcugacccagaccacccagggcagcggcagcaccagagcccacagagccaccguguacgugggcggcgccgaguucacccccaagcugggcaaggugcaguucaagaccgagaccgaccacgaccugaccaucagacagaacaccaaguucacccccgugggcgugauccaggagagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga

SEQ ID NO: 25994 - RNA, 1614 nt, Artificial Sequence
  derived and/or modified sequence opt4 from VP1__Norovirus_and/or_Norovirus-like__AB985437
augaagauggccagcaacgacgccaaccccagcgacggcagcgccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccugagcagaauguacaacggcuacgccggcggcuucgaggugcaggugauccuggccggcaacgccuucaccgccggcaaggugaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccaggcccacgacagcacccugaagcugaucgccaugcuguacaccccccugagagccaacaacgccggcgacgacguguucaccgugagcugcagagugcugaccagacccagccccgacuucgacuucaucuuccuggugccccccaccguggagagcagaaccaagcccuucaccgugcccauccugaccguggaggagaugagcaacagcagauuccccaucccccuggagaagcuguacaccggccccagcagcgccuucguggugcagccccagaacggcagaugcaccaccgacggcgugcugcugggcaccacccagcugagcgccgugaacaucugcaacuucagaggcgacgugacccacaucgugggcagccacgacuacaccaugaaccuggugagccagaacuggaacaacuacgaccccaccgaggagauccccgccccccugggcacccccgacuucgugggcaagauccagggccugcugacccagaccaccagagccgacggcagcaccagagcccacaaggccaccgugagcaccggcagcgugcacuucacccccaagcugggcagcgugcaguucaccaccgacaccaacaacgacuuccagaccggccagaacaccaaguucacccccgugggcgugauccaggacggcgaccaccaccagaacgagccccagcagugggugcugcccaacuacagcggcaccagcggccacaacgugcaccuggcccccgccguggcccccaccuuccccggcgagcagcugcuguucuucagaagcaccaugcccggcugcagcggcuaccccaacaugaaccuggacugccugcugccccaggagugggugcugcacuucuaccaggaggccgcccccgcccagagcgacguggcccugcugagauucgugaaccccgacaccggcagagugcuguucgagugcaagcugcacaagagcagcuacaucaccguggcccacaccggccccuacgaccuggugaucccccccaacggcuacuucagauucgacagcugggugaaccacuucuacacccuggcccccaugggcaacggcaccggcggcagaagauga

SEQ ID NO: 25995 - RNA, 1614 nt, Artificial Sequence
  derived and/or modified sequence opt4 from VP1__Norovirus_and/or_Norovirus-like__KF712494
augaagauggccagcagcgacgccaaccccagcgacggcagcaccgccaaccuggugcccgaggccaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgaggugcuguggagcgccccccugggccccgaccugaaccccuaccugagccaccuggccagaauguacaacggcuacgccggcggcuucgaggugcaggugauccuggccggcaacgccuucgccgccggcaagaucaucuucgccgccgugccccccaacuuccccaccgagggccugagccccagccaggugaccauguucccccaccugaucaucgacgugagacagcuggagcccgugaugaucccccugcccgacgugagaaacaacuucuaccacuacaaccagagcaacgaccccaccaucaagcugaucgccaugcuguacaccccccugagagccaacaacgugggcgacgacguguucaccgugagcugcagagugcugaccagacccagccccgacuucgacuucaucuuccuggugccccccaccguggagagcaagaccaaccccuucagcgugcccauccugaccaucgaggagaugaccaacagcagauuccccaucccccuggagaagcuguucaccggccccagcagcgcccugguggugcagccccagaacggcagaugcaccaccgacggcgugcugcugggcaccacccagcugagccccgugaacaucugcaccuucagaggcgacgugacccacaucaccaagacccacagcuaccagaugaaccuggccgcccagaacuggaacagcuacgaccccaccgaggagauccccgccccccugggcacccccgacuucgugggcaagauccagggcgugcugacccagaccaccaagggcaacggcagcaccagagcccacaaggccaccguguacaccggcagcaccgaguucacccccaagcugggcagaauccagcuggugaccgacaccgacaacgaccuggagaccaaccagaacaccaaguucacccccgugggcgugauccaggacggcgacacccaccagaacgagccccagcagugggugcugcccagcuaccugggcagaaacaaccacaacgugcaccuggcccccgccguggcccccaccuuccccggcgagcagcugcuguucuucagaagcaccaugcccggcugcagcggcuaccccaacaugaaccuggacugccugcugccccaggagugggugcaguacuucuaccaggaggccgcccccgcccagagcgacguggcccugcugagauucgugaaccccgacaccggcagagugcuguucgagugcaagcugcacaagagcggcuacgugaccguggcccacaccggccaccacgaccuguucaucccccccaacggcuacuucagauucgacagcugggugagccccuucuacacccuggcccccaugggcaacggcaccggcagaagaagauga

SEQ ID NO: 25996 - RNA, 1614 nt, Artificial Sequence
  derived and/or modified sequence opt4 from VP1__Norovirus_and/or_Norovirus-like__KX514315
augaagauggccagcagcgacgccaaccccagcgacggcagcaccgccaaccuggugcccgaggugaacaacgaggugauggcccuggagcccguggugggcgccgccaucgccgcccccguggccggccagcagaacgugaucgaccccuggaucagaaacaacuucgugcaggcccccggcggcgaguucaccgugagccccagaaacgcccccggcgagauccuguggagcgccccccugggccccgaccugaaccccuaccugagccaccuggccagaauguacaacggcuacgccggcggcuucgaggugcaggugauccuggccggcaacgccuucaccgccggcaagaucaucuucgccgccgugccccccaacuuccccaccgagggccugagccccagccaggugaccauguucccccacaucaucguggacgugagacagcuggagcccgugcugaucccccugcccgacgugagaaacaacuucuaccacuacaaccagagcaacgacagcaccaucaagcugaucgccaugcuguacaccccccugagagccaacaaccccggcgacgacguguucaccgugagcugcagagugcugaccagacccagccccgacuucgacuucaucuuccuggugccccccaccguggagagcagaaccaagcccuucagcgugcccauccugaccgugggcgagaugaccaacagcagauuccccaucaaccuggagagacuguucaccggccccagcagcgccaacguggugcagccccagaacggcagaugcaccaucgacggcgagcugcugggcaccacccagcugagcagcgugaacaucugcaccuucagaggcgacgugacccagaucggcagcaccaagcacuggaccaugaaccuggccagccccaacuggaacaacuacgaccccaccgaggagacccccgccccccugggcacccccgacuucgugggcaagauccacggcaugcugacccagaccacccaggagaacggcagcaccagagcccacagagccaccguguacgugggcggcgccaacuucacccccaagcugggcaaggugcaguucgagaccgacaccggcgacgaccuggccaucagacagaacaccaaguucacccccgugggcgugauccagagcagcgaccaccacagagacgagccccagcaguggagacugcccaacuacagcggcgccaacaccuucaacgugcaccuggcccccgccguggcccccaacuuccccggcgagcagcugcuguucuucagaagcacccugcccggcugcggcggccaccccaacauggaccuggacugccugcugccccaggagugggugcagcacuucuaccaggaggccgcccccgcccagagcgacguggcccugcugagauucgugaaccccgacaccagcagagugcuguucgagugcaagcugcacaagagcggcuacgugaccguggcccacaccggccaguacgaccuggugcugcccagcaacggcuacuucagauucgacagcugggugaaccaguucuacacccuggcccccaugggcaacggcaccggcagaagaagauga
